United States Patent 11,583,558 (METHODS AND COMPOSITIONS FOR TREATMENT OF MICROBIOME-ASSOCIATED DISORDERS) - sequence listing, part 12

SEQ ID NO: 12 - DNA, 3443606 bp, Eubacterium hallii WBS-01 (residues 1-1,721,803 of 3,443,606)
tcgcaccaatatgatcctcgtgtccgtgggtaattacaagtccctttacctttgaggcattctctttcaaataagtgatatccggtataactaaatcgattcccaacatctcatcgtccggaaaagccagaccacagtctactacaataatactgtcctcatactcaaacgcagtaatattcataccgatctgctctaatccgccgagaggtattatctttactgattgatttcctgttactttcaaattctaacctccgttctactattcacttgtctatatagcagaaagcacaatcgcatagaataaaacggacatctattcctgccaaatatctgccgttttatctcacacgaaagcctgcctgctattctacttcaaaattaatatcgtccattaactgctcaaatactttggatactgatataagttcttcctcgtcttcaaccatctcataggttgcccattcttcatcctcagccgcatcagcaactcttttcatgataagaacttcaacctcctcgtcatatctgcatctgcacttccgtcttctactaacagatagtgaaatccattcagagttgtctgttcgaggacatagaactccttttcttttccatcttcgtctttaaatggaatactctgataattgttctcatataaaacctctttcttccgtacttacgtccgttctccgcttactttccggaattggatgtacatccagtaactttgcagaatcagagtagccgccatccagtcaatgcgttctttcctgttctcacggcgcactccgccttcctgcaaaattctctctgattccatcgtagtcagtctttcatcccataagactacttccaatccggttctgcgctgaagcatcgcctgaaactccttcgtctcctcagctctttctcccagcgtattattcatattctttggcaatccgagtactatcttactcacttcatattcttctatgagcgcttctatccttgccaatgtctggcgcagcttcttattcgactttctggtaactgtctcaactccctgtgccgtaatacccaaagcatcacttaccgccacacctactgtctttgtcccgtaatcaagacccatccatctttctttcataattactttaactgagtatcaatataattttcaaataaaacttcaagaatctcgtcacgttctaccttcataattaagcttctcgcattcttatgactggtaatataagtcggatctccggacataatataacccacgatctgattcactggattatatcctttttccgttaatgcttcgtatacatctttcaaaatagatgctacatcatattcctgttctttaaccacatgaaaaaactgtgtattatttctacccatgtctacctccttctagcagatttacaatcaataaatattttactatgagtgacattaaaattcaatcgaaacttttccgtacagtaaattttcatcaataaatccctgaatatctactacaattacctcattttgttctaattttgtatcattttccgttaattccactgcaactttcacataatgagccgtatatccctgaaaatattttttaccatttttctctacaatttcttctaaaagtactttttcttttcttccaacataccattcttcaaatgctgtcttgtgcctttttgccatcgaaagaagcacctcggaacgttctgtctttacctgttccggcacatgcccggacatcttctgtgctcttgttccttctcgtacagaatacttaaaaatatgcatctcatatagattgattttctcaagatatgctcttgttttttcaaattcttcctcagtttctccgacaaaacctgcaataacatcagttgttaatgccggatgctcatagtactttcttaaaatatttaatgcttcctcatattcttctgttgtatatttgcggttcatacgctttaatgtctcgtcgcagccgctctgtaaagaaagatgaaaatgtggacatactttatcacatttcacaagttcttttacaaactcctctgtgataattctaggctctaaagaacccagacggattctctccacatcctctacctgctgtattctcttaatcacatcaagaagagtcactgttcctaaatctttcccataggaacttaaatgaattccggtaagcacgatttctttataaccctgtgctgccagattttttacttcttcaatgacttcctctggatttttactgcggattcttcctcttgtgtaaggaatgatacaatacgaacagaactgattacaaccatcctgtattttaatatatgctcttgtatgctcgtttaccttatgaattgttaaatcttcatattcttttgtgtgattaatatcaattacttctgagacaactggtacctcctgctctggttcttttgccgcaaaatattcctcaaggatctgggcgatatctttctttttattattaccgacaagaatatccgcctcatttttctttgctagttcttcctctgctgcctgcacataacaccccgctgccacgataattgcatccggattgtttttctttgcacgatgaatcatctgacggctctttctgtctgccatatttgttacagaacaggtatttataatatagacatccgctgtctctttaaaactgacaatctcgtatcctgccttttcaagaatctcctccatggcatcagtctcatactgatttactttacagcccagtgtaaggaacgccgctcttcttttactcataaaaacaaatctcctttttccgtttctccttttcgttttttctgttatttattatttcctacctgcaatcctattttttctaacttcattcatctccagattcatgccaaaaaattcccctttatctttagataatattttccaaatcttcctcaaatctattgactttttttcactaaaaaggtactatattattaaaatatatatagacatttttaggaggagcgcgtatatgaaaacgattaaaatctctttaaattccatcgataaggtaaaaacatttgttaatgtcatcaatcgtttcgatgcagaattcgatttagtttccggtcgttacgttattgatgcaaagtctatcatgggaattttcagtttagatatttctaaacctatcgatttaaatatccataacgctgataatcttgatgagattatggaacagttacagccatacttagtaactgaataattacataagagcgggttttctggtatacggatatattatatataacctgtgatgtatttatgaaatcaaccgaggaaatattactttcctcggttctttctttacagataaatttttcttatatgaatcttcagataaaacaaatatttttagtgatatttcttcttcccaccttttaaaaaggcacttatctgcaagcattataaacattatcaaaatacttatgtctgccttgaaaatgctttcatccattaatactttagtgagcgttaatcttaatttcttctgttgtttcaatcgctgtcttcatcagctcgtcaatacaatcatcaagatttctctcagaacgcttaattacatctaatcttggctttgttaccggatgttttgccacaaaaatagtacagcagtcttcgtatggtaaaatagatgtctcatatgttccaatcttttctgcaacttttacgatttcatttttatcaagtccgatacaaggacggaatactggcatctggcacacttcatttgttacataaagactgtgcattgtctgactggcaacctgtccgatactctcacctgtaacgagggaaagacaattatcctgatttgcgaaatgctctgcaatcttcatcatgtaacgacgcataatgattgtcaattcatcatgaggacatttctcataaattgccatctgaatatctgtaaagtttacaacatgtaatgtaataggtcctgtatattttgcaatctcttttgcaagatctactactttctgtttcgctctctcacttgtataaggaggtgcatggaagtaagttgcgtcaatgcttacacctcgcttggaaatcatgtaaccagctaccgggctgtcgataccaccggaaagaagaagcattgctcttccgtttgttccaacaggcattccacctggtcccggaatctctctggaataaatgtaaaccttatcacgaatctcgactgtaagcataacatctggattatgcacgtcaacacttaagtcctcaaacttctctaataatctctctccaagacgggcagctgcttccatagacggaattggatacttcttgtctgctcttcttacatgtactttgaaagaaaaatgcttatctgcataatcttcatctacatatttttctacgacttccgcaatcttttcaaaatctttatcttcttctactacaattggacaaatacctgcaataccgaatacatggcttaagctttccaccgcctcatcaaaatcatactcttcattggcatgtacaaaaatacgtccagattcctttctgatagaaaagtctcctactggttttaatgcatatttcatctgacggacaagggcatcttcaaagaaacggcgattatttcccttgattccaatttctgcatatttaatcaaaaatgctttgaattccataaatatctccttttttatatgatgtactctcgtagtctttcttgtcacaaaatcaagctcaaaaagattccgagagtacattatgttctaattgttttatcgtcttgtaaatctccgaagcatcggcaacagttcttttaacgcttccacacaaatatctgcttcttctaccgtattaaaaatagagaatgaaaaacgaagcgtcgattcatagtattcctttgtaagaccaatgcccttcaaagtaccgctgacttccggtttattagatgaacaggcagaacctgctgatacataaatctcacgttcttctaatgcgtgaagaagcacttcacttcttactcctaaaaagctgatactcgccacatgcggagcatctccggaattatctttcacatctggaatctcttccatcactctttttataaaatgatcttttatctctctgatatgtgcgatcttttcctcatgattctcataaatcaactctgccgccttaccaagccctgcaattcccggtacattttctgttccggaacgcattcccttctgttgatttccaccccagatgattggctttatctttgttccattcttaatataaataaatccgattccctttgggccgtgaatcttatgtccacttacagaaatcatatctgctttccatttcttagggtaacaattcaacttaccatatgcctgaatacaatcggtatgaaataaaatctttggatcaaaagactttacaatctttccaatctcctcaaccggttcgatggcaccaatctcattattcacgcacataatagaaaccatcaatgtatctttacgaagcgccttctttaatgcctctaaatctacgattccatgttcatcgacaggaagataggtcacttcaaatccctcatcttccaaaaaagataatggattatatacagaagcatgttcaatacagcttgtaataatgtgctttctctctcttttatttgcaaatgcagtaccgatcaatgcaagattattcgcctctgtaccaccagaagtaaaataaatctcctttgaatcaactttcaggctctttgcaataatctctttcgcatgattgacatacttctctgcatcaaatcctttcatatgcatagaagatggattgccgtactccttctcaagtacttcatccataatctcacgcacctgcggcagcgctcttgtggtcgcgccattgtcaaaataaatctctgacattctcgtttacaactccttcaaaaaatatattatgtcttattgtttttttgttccattctctacactcaaaaaacagccataaaaaatggcataatcgtatataaacataacataaaatgagagagaagtaaaatggattttgcggataaacagacgaaaatgaaaaaggatactcccctcaagctgtaaagatagtcgttcgagcaaaatgctcagtcgcattttcactcactccgacattacatcttgaggggagtatcctttttcattttctgtttgttggctctccaaagtcattttactggctgttagagaagaagtggttaaaaaataataactttaagctttatgattattttatcttatatgactactttaccttgactttaaaggttgcttttttgttacttccgtcggttgccatcgctgtgatttttatagtttttcctttggcaacctttttagttttgactacgcctttggcattgactgtagcatatttcgcgttggaggatgtccactgtaactttttattcgcttttttcgtagcggttacgttcgcttttaatttcaggctttttcctgctttaacagttttagttcctgtaatttttaccttctttacgattcctttcatggaagttactttccaggatgcggaaacctttatcttatcgtttgatgctgttattgtaactttctttcctccggttttctttttcactgttacaacaccatctgcgttgacagttgctaccttggtattgcttgacttccaggttaactgttttgttatgctgtctggcagcccgatttcagcctttaagttcacctttttgcctgcggcaatctgttttggctttccggttgctttaaaaggttttatagatggagcatttgttgtgttaccagatggttttgttgtgttgctggacggtttctgggttccctgatttgcattttttgaaaaatgtgctgacaggtttctgttattctgaacacagaagcggtattctttttcttttgaaatcagattatcattttcataccatcctgcaaatgtataattagtttctggctctgcagttacctttgcatattcgctgatcgtatagcttccgccacctgtaacacttccacctgactgcgcagtaacatttacctgttttttaatatcttcggaagcacctttttctatcgaaggctgtacttcatctccactgacatttttaagcgtttctgtagaactttctgtatctgtttcaaatgtacttttgtaaacttctccttcttttatcggaatatcaacataactttttacctggctacattcattagtttccagattctgattcataacggtatatgtcattgttccgttatccgttgcttttaaatcctctttgtagtcagcatcttcagggatacatacgattttctgaccattttcatcaataggtattaaatgtgttagcaaatatgcattatcaagaggatgctttgcagcaagtcctggtatcactcttgcaattgtcactgcaagggctccggtatccaatccactgttctttcctaatactcctgccattccactaatcatatttgcctgcagcctcatataataattttctctattcactgcaacatcgcataaatcatccatcagcttatccatcatagaagcctgcgcaagcccttctttcgttaaatataccaccgcctgcattggaagatataagtttttcacttctttctccgtccaatcatacattctcgctcctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctaggatgcagacagatattatgttatccaaaaacaataacatacttattattgatgccaaatattattcgcatatgacccagcaacaatacggaatacatactctgcattccaataatctttatcagatttttacctatgtaaaaaataaggaatttgaattgagaaactatgaacatactgtatcaggaatgcttctttatgcacaaaccgatgaagatattattcctaataacacctaccatatgagcggaaatcagatttctgttcttgcattagatttaaaccaggatttttcaaaaatctccagaactttagatgacatcgccaaaaattttctttaaaatttttaaaggaagggacctaatatcccttccttacttctattacccctattgtaacaaaaaatctataaacttcctcataaagcgaagaaccaaaatggatacacctatagctgccgctatacatacaattgaaaaaaacatctgaaaaatcacctgactatccatagcatatgaaactgcgttattcattgtatctccccctgactatcttttgatacttcattttaccatatctctgtatttttatcaaaaatttttcattttcaaaattacattttttatgttattttacatttattagttgtttttcttcttaaatatgatatactattcctcaccagttgtatcaccgagttcttgacacacgtatattatacgtattataatataattatagaaaggggtggcatactatgccaatgaaaccaaaagaaatgataagattattaaaaaagaatggtttcataaaaataagtcaaaatggttcccatgtgaaaatgaagaattttaaaactggcaaacaaacaacagttcctcttcatagcaaagatttaaaaaaaggactagaagatgccatcctaaaacaagcgggcttaaaatagccttatttcatctataataactcacatacattggaggtatccattatgaaaaaattattttatcctgctgtatttcatattgcagaagaaggcggttattgggtgacttttcctgactttcccgaatgtctaactcagggagaaaatatgcaagaagcctatgatatggctatagatgctttaggacttatcttaactgatgacattaacgaccataaagaacttccagaaccgtctaacatcacacatgttgatgatggagttgtcgtaatcatcccatatgattatttggaatataatcgaaagtatcataataaatctatcaaaaaaactttaacaatccctgaatggttgaataacgaagcattgcgattgaatttaaacttttcacagattttgcaggatgctcttttaaacaaaattcaatctcgttaatggctataattctttcatttggtaatactgcaatcatagattataatatacttaacaaggcatctaatacgatagcttcacctatccatttccggcaagtttaggttaaaaaacagaacccccacaactttatagatagcaaatgtgatgtcggagcaagtaaaaatgcggctgagcattttctacgcagcgaaatcttcacatgtgctatctataaagttgcgggggttcgtctgtttttaatctaaatcaatcctacaccggatatgctccattctttacatcggcttttgcaggatcaatcttattctcctgtgccgctctgtatttaaagaattcggttgctacctgtgggaacaatgcgtatgtaagcacatcttcgtcctgttctttccactggctcatctctgcctcgatcttagataattccggttcaagaaggtcggctggacgacaggtaattggcttttcatcgccgattgcctttttctgtacttctttattcattggttttacggtttgaccgtattctccacgaagaagggcttttgactcgtttgtaatcattttataacgctctccggtaagtacatttaatacagcctgtgttccgacaatctgactggacggtgtaactaatggtggttcaccgaaatctttacgtacttttggaacttcctctaatacctcatagaacttatcagatgcgccctgctgctctaactgagatacgaggttggaaagcattcctcccggtacctgatacattaacgtcttgatatttacgccaagtacctttggactcattaaaccatttgccagatatttctcacgtattgggcggaaatagtctgcaatctcgcctaaaagcttctggtcaaatcctgtatcaaattctgtaccgcggaatgtttcagccataacttctgttgccggctggcttgttcccattgcaaatggagatatggctgtatcaatgatatcgactcctgcttctactgcttttaagtaagtcattccaccgacaccacttgtatagtgtgtatgaagttcgataggaatgtctgttgcctgctttaatgcagttacaaggcgagttgcttcattcggcactaaaagtcctgccatatctttgatacagatagaatctgctcccatctcttcaatattcttagcagtctttttccagtagtctaatgtatatgcatcaccgattgtataggagagggcgatctgcgcgtgtcctccctctttctttgttgcatctacagcagtctgtaagtttctaaggtcatttaaacagtcaaaaatacgaataacatcaattccgtttgcaatagatttctgtacgaaatattctacaacatcgtctggatatggcttatatcctaagatgttctgtccacggaataacatctgtaactttgtattcttaaagccatctcttaatttacgaagtctctcccatgggtcttcctttaagaaacgcaggcaggcatcaaatgttgcacctccccagcattctactgcatgataaccaacctgatccatcttatctacgattggcagcatctcctctgttgtcattcttgtagcaatcagagactgatgtgcgtcacggagaacggtttctactattttaaccggttttttcttaatttcggccataatatctccttttatttcaaatcacgtaactatttgcgcttacaactgttattatctaaaattcaacttgtaaactatttataaatatcccctgtaacattttttacagattatagccctataaataatgaattttaaataatcaaataattctaaattatactccaaaaattgccataaatgttccggctgctaccgctgtaccgataactccggcaacgtttggtcccatcgcatgcatcagtaagaagtttgatggatctgcttccgcaccaactttctgggatacacgggctgccataggaacggcagataccccggcagaaccaattaatggatttaccttaccacctgtaaccttacacataagtttaccaaacaggacacctgctgcagtaccaacagcaaaagctacaagacctaatactacaatcttgattgtgctgacatttaagaatgcctctgcacttgttgtcgcaccaacggatgtaccaagaataataactacgatgtacataagagcgttagacgctgtctctgaaagctgttttactacgccggactctctaaaaaggttaccgagcatcagcataccaactaatggtgctgttgtaggaagaatcagacatacaacaactgttacaacgatagggaacataattttctctgtttttgtaacggttcttaactgttccatcttaatctgacgttccttttctgtagtaaggagcttcatgatcggtggctgaataattggtacaagtgacatataagaatatgccgctaccgcaattggtcccattaagtctgtctgcccaagctttccggcaaggaaaatagaagtaggaccatcggctccaccaataatggaaattgctgctgctgcctttccgttaaatcccataagcattgcaagaaaatacgcgctgtaaataccaaactgcgccgcagctcctagcaagaaacttgctggattggcaatcagcggaccgaagtctgttagtgctccaacgcctaagaaaatcagtgaagggagaatactccattcatctaataagtaaaaataatgtaataatccgccttcttccataatggacggatataagttaaccagcagcataccaaaagaaatcggcactaacaaaagtggctcatatcctttggcgatggccagatataagaagactaaagcaaccagtatcataatgaagttacctggctttaagaatgcaaatccggtctgtgctgcgagattcgtcattgtctctacaacataactcataaatcttcctccgttttattttgcaaatatgctctagttcattgtagccagtacatctccgccttctaccatatctccaactgctacttccacacttgcgataacaccatcctgtgctgcacagatttcattctccatcttcatagcctctaatacaagaacagcgtcgcccttctttacagaagcacctgcctgtgcctttactgctacgatcttacctggcattggtgctgtaatctttacggcaccggcacttccggaagtctttggggcagctttcttagctggagccggaacggctgctggtgtacttaccggcgctgcactttcttctcctgcacctaattcttctactgctacatcataagcaacaccattaactgtaattctataatttttcattgtaaatcctcctgaatgattttatgtacttctaaaatctttctatagctaacttttcaaaactttataaaaagattccaagaatacatttttgctatcttctcttcactctcttgattgaacgaacgaccaacttatctgcactgactgctgctcctccattcgctgccatgattgccgctgtgattactgcgacaagttcaccatcatccacaagttcctcttcttccacaacttcttcaagaatcggacgctttggagccggtctttcttcctgcgcagcctttttctctttcttagaagaacgattctttaacgctctttcaatagatgggatatatacaaaaagagaaatcagtaaagaaatgaaaatcagtactgcaaatacagttcccatacccatcaaagtatttaataaggcttgttcaaatacgttcatactctcacctcactatactgccgtatgcttctttgtcactggagttactttctttccgtaaagcatttcataagcagcgataagacgctttcttgttgcgtccggctcgatgatgtcatctatatatcctctctttgcagctgctaatgcactgctctgtccttctgcatattccgcagttttctctgcgataagtgctgtcttattcttatctgtattgatttcctctgcatacatgatacgaactgcctgttctgcatccatcattcctacagatgcctgtggccatgccagaacaaagtcagctccgatagctttagaattcattacttccgctgcagttccataagcctcgcctgcaatgagattaatacgaggtacactaacctgtgcaagtgttgttgtaaacttcgctaatgcgagcgcctgctttctctcttcatgtgcgttggcacgaagtcctgtcacgttcgttacagtaagaagaggaatcgaaaatgcatcacagaacttaataaatctttctgctttttcaagaccatttcttgttaaaacggactcaccatctactggctggtttgcaaccgcacctactgtctctccattcagacggataaatgcagttaccatctctttggcataggctgcctttgtctctatgtacatattgttgtcagaaatagattttaaaatgtaagcggcatcatatgcggcatcatttaactcaggaataaccctatttaaatcatcatcgttatcaaagtaaacatcttctgcttcataatcagaaggaagtacatcaacgagaatacgaagctggtcaagaagtgcttcttctgtctcacatacaaaatctacgttaccagcctgctcagactggaactgtgctcctgacgtattctgacgggattcttcattccccgctaatgcattcggactgttgataaagagactgccgttctccttctccatcaatgtaaaatcagacatagcggacattacggcacttcctcctccacacattccaaatactgcagaaatctgtggaatcattccagatgcctgtgcctgcttattaaaaatcgttccaaaagcgtgaagggcatctgtcgcttcctgtaatctaagtcctgcacaatccagcattccaatgattggcgcacctgttttcatcgccagatcataaagggaagcaattttcttcgcatgcatctcacctacggaacctccaagtgcggaagcatcctgactgtaaacataaaccatgcggtcattaataactccgtatccagtgataacaccatcaccttctactttctttgcaccgagattataatcggtattacgagcggaaacatatccaccaacttccacaaaactgtggtcatcaaacagataatcaatgcgctctctggcattcatttttgaattacccatattctttcctccataaaaatgctatattgtataccttgttgctctttcattctatgtaataataacaaattattatcatgttagcaaccattttctgttagttatttaacatttattttattttgcccattccactaaacaaaatgaacattctgcctatttgcaaattttttaacaattctttcaattttctttctgaatctcctgtttttttcaggaacgcttgtgtatttttcctgtttttctctattttatctttaaaattctatttttgttttatatgtccatttttatttcgttataattttaacgtattttgacattcaattactagttggtttttctattttttcgtcattttatacaaaacattctcattctatcaaatatcttccgtttttcttcataatttcactcttatttccatcattcttcttttctcgcttacattctcctcctgtcttttttaaatcaaagatatagtatccaaaatcaattttgaactatttttgtcaaacttttttcacaaactaatagcgctccctttcattttatacaactgtatatgcataccatgaagtattttcaaaaaatcagaaagaaattataaactgtcaagaaaagcctgtaattttgcacaaatactcctttattttttcacacaaaaaaggtataataaacaaaataaacaattctttcacaataaaggaggaggacatcttatggaaaaccgcaaaattcaatttcgttcaaaagcctgtaatctacatctttctgcctatccgggacatttcgcaacaaagcattctcatgtcaactactttttagatatgacaacattaaaagtacgtcagtctaatgcagaagaagctgcaagagcgttagttccactttataaacataataccgtcgtcgataccatcgtatgtcttgacggaacagaagtaatcggtgcatttttagcagaaaagcttacagagagcggattcttctcttacaaccagcataaatctatctatattgttactccagaaatagattcagatggtcagatgttcttccgcaaaaatatccagccaatgattaaagatagaaatatcattattttaatggcatctgtcacaactggaatcacaatcaaccgaagctgggaatgtatcgagtactatggtggcaaactgcagggaatttcagcaatatttagtacgctttctgaatatggtaatcttcctgttaattcgctgtttactccaaatgatattcctacttaccatacatatagtaagcatgactgcccatattgtaagagtggtcagaaaatcgatgctttggtaaacggacatggatattcggaattattataactactaatttgctggagaaacagacgccgctttagcagaagatattgagctgaattgtaccaggtcttctaaaaaaagaattgttataagtttgattttgttccgttgcgctaaacgcttcattttgcctaataaaacaaccttgctcgaaaacgagctcgcaaggttatagtcaaaattccgcagcacaaagtcacaaaattcaaacttataacaattcttttttatttatcatagtcttcttacaattcagcataaaattttatttcagcggctgtctgattttgataacaaatagcaaattaatgatttttgttggaaagagaaggagattccccatcctcaccaactgtggatttaggataatcagaaaaaagaaacaataccatatcccagatgcggcttcggagcgtgtttaggatgcggatgagcatcttaaacacagcgactacagagcagatgggatatgatattgtttcttttttcgtctatacgaaatctacaaattagtatttacaaattagtacgtttttgttcttttcataaatacatatcctcgtctgcactattcacaaggtctggaatggttctgacttcttttgtaaactgtgcacagccaacagacattcctatatcatatggagaggctgcctgtttattcgctttctccagattttcatataagtttttaatcagatgctccgcctcttcccgaagcatctctccggcaatacagaattcatctccgccatatcttgcaagaatacctgcatgtcctgccagtgtttttttcaaaacccctgctatccttatcaatgccctgtctccttcaacatgaccatatgtatcattaatccatttaaaatcatcaagatcaatcatcaaaaaatgtaaatctgtttcttccccttctgtatgtctttccatatatccttccaaatactgcatcagctttgttcggttattaatctgcgttaattcatccattgtaattctatttgtaagaaatgccgtaaatacctgaataattccaagtgtcagtccaaaacaaataatagaaatctctgtgaaaaacatttgcaaaacacctgcaataaccggaaatacgaccattccaaatatcatctccagctttccacgaagtgcataatacttcttttgaggaaacattgtaaaaatgcgaagtgtcaccaaaaaaatataaatataaacaaagtgaatagaagttttgtatttaaatggaagtggtaatgagttgagattgataacaacagtctactttttattctgaaattattgaaatattgctgtggtaatcattgaaaaagagagcttttctatattttttaagttccatttttatgagttatatgtacatacctatgattattccaaaaggtctagataaagaagcagattctaactaagtctgacatgattatattatgttatccataatatttataaaatcaaatttaaaataccgttttttctctctatactatatgtagtcaaatcatatcttctatccccagtcattcttaaataagcagaacacctggtatctcatcctcaaattcccctccccctgtttaattcaccttctcaagccacagcacagaagccattacccccaataaggcatatttgtggtctcggagcaaggtttggatgcgagcgcatgagcgaacattcaaaccgccacgactaaaatcacaaatatgccttattgggggtaatggcttcgtctatagttcacttaatgaattaaatagtaattacttctcgattgccttaaacgctgctgcctgcgctgtcattcctctttcagaagcaagtctttcgatagaagatgctccgaagaatccatcgatttcaggtacattgttaattacatatgctgcatcttctgggtctgcaattgggccgccgtggcagataaccatgatatctggatttacttcttttccagctttgataatctcacgaatcttttcgcagcagtcatctaatgttaatgctgtttctgctccgatagaaccttttgttgtcaatcccatatgtgctacaaggatatctgctccagcttctgccattgctttcgcctgttctggttcaaatacatatggacatgttaacatatcaagcttatgtgcttcacgaatcatgtctacttcaagaccatatcccattcctgtttcctctaaatttgcacggaatttaccatcgataagaccaaccgtagggaagttctgtacaccgttaaatccctgctcttttaactgttttaagaaaatatccattacacggaatgggtctgtaccacatacaccggcaagtactggagttttctttacgataggaagtacttcctgtcccatttcctgaacgatggcattggcatcaccgtaagaaagaattcctgataaagaacctcttcctgccattctgaaacgtccagagttgtaaatgatgagcatatcaacgtctgctttttcactacattttgctgtaatacctgtaccagctccaacacctactaagattttcccctgtgctacctgtgccttaaagtcttttaagatttcttctctgctttttcttaacataatcgttacctcctgttttttaaatgattttatttatgtaatttattatttaccttcgttaatcagttccattaatttttgtgcggctgccttggcaaatgcctcatcattaatattgttatccatctcgacgatttcaacattttcattagagatattattttttaaagtatcaaataatacttttctttcctctggaccatcaaatggctgtcctttagcatcaatcattgaaacaccctgttttggaaggaagagtgtcatcttattctctgtctcattccatctctctgctaacttctcagcaattactttattttcctcaacggatgtacgcatcagagtaactaatggattgtgtttgtaaagatttctgcctgcaaactgctttggcacctcatcaattggcccaaaatttaccatatcacatgcaccaacagaaacaacctgtggaatctttttgcggatggcagctctgcatctgtcttctccggcagcaagaatacctccgactacctcatcgcaccattcagttgtggtgagatctaacactccggtaaagaatccagattcaatgagggattccattgtttttccgcctgtacctgttgcatggaaaacaagcacttcatatcctgcctgttccaacactgcttttgcctgttctacacatggagttgtaacaccaaacatagatgctgcaattaaaggtttctcctctatagtttcttcttctgcaagtttttcctgtccagctaccattcctgcaattgttaatactgcatttttgaaaataatttttgaaatcttattaattcctgccacatcaacaatagacggcatcattaagatgtcacttgttccaacatatctttcgacatctccagaagccatcgtagaaaccatcagctttggtacaccaatcggcagtttctgcattgccggagttactaatgaagttcctcctgaaccaccaaaagaaagaattccatcaaatttgccttctttgtaaagctgtggaactaaaaccttcataccattagaaagtgcttccgtcgctaatgctctgtcttttttttctacgattttatcaatatcgtatcctgctgcctctgcaacctccctgtttgatacatctggttcaaacgctggctcaaatacaccagtatgaatcatatatgtctgaagtccaagtttttctactaatttttttacatatagaaattcttctccttttgaatcaaaggttcctgcaattgcgattgtcttcatcttttctcctttctccttgtaactctcccattgtgaaaaatattctgacaacttaatatataattcatgaattttaaaaaagaagtagaattttgtctttgttgtgactctattctacttctttttctgatgtaagtaaatgtgtttatatttgtatctcttgtatttatattttaaacactactatctttattcacttttcttgtgtttatattggttttcctcttctaaagccattctttgatactctttcggggataaccccacatatttcttaaatatctttgaaaactgtgcgtaatccttatatccgacattttctgccacttcccggcagcggttctgcttctcttttaacagattctttgccttattcacccggtaacgaatcagatattctgtaaaacttgccccagtttcctttttaaaacgggtacttagataagaaggggacacatgtgcaaccagcgccagatccccaagaataacctcatccatgtaatgttcctctacatatttctggacaaactccaccgtcgttcttgcattccagtctccatcaagtaaacgggtcatcggattattcctgtcaaaatctccgtaacttttaaaagctttcattgtattatatatcgcccgctctgtaggaatcctatcaaaagtagaaccgccgatgtacccctgacattctgtattctgatacatatactgcatatcaatcggcgtattggctggcccagcatagatcatttttataatatctggattcatctcattgcagagtgcataaatcttatccgtcatccttcttgcatcttcaatagaaagatgtcttttcggcccaagaaatcctcctttcgtcaaccccagattcacacaaatcacatctgcccctgcctcgatcatctgccttgtttcttcttctgtcgtaacaaaggcaatcgtaaataaatcaagatatcttgccagatgaatcgcctctacttcctgtttataagtatttccctcttcctctaacgcctcccgaaactgtccatcaatcaatgccatcgtcggaaaatttacaattccagaaaatccagcttccttaattgcttttaaatgttcgtacaaatgaagagatggatcattggccatcagtccgaatacaatcggtgtatcttttataataggaaaaagttcccgctgccccatctccattacctgctcattactatttccataacaaaaatagctggcaaaagagctccgtcccataatacggtactttcccgcactgagtgccaataataagtctgctcctcccattgccgcaaacttagccgtcataccagagcctacagccgctccgataatatgaccatttacattaatctgcgcgcgcaataatcttaaaatatattctctatccatctcatcactttctttttaccaaacatctctttaataacaactgagttttacccgaaccgttctttcctgttaatagaagatgctgacgtttttctgaatttaattttatttttatatctgataaatagtataatttttctatgtcaatttcgctgataagatattccctcaattctgtccttcgaatttctattatttttgcatgacactattttattaaaacttttacatcaaaatggtattgtcttagcaaaacaaatattctatactattattattatagcatggcacaaaacccttttcaaaccatctattttaaattatcatattaaaacaacataaccacgaaagcgaggaaaccatgaacaaattttataaagcactcgaagaaaaaataaaagcatccggctacccaagagagatttccggaagagacgtatataatgatatctgtgatcagattgaagataaggaaaatggaacctatctggtgttatctaaatttgaagatgacgtaacttttgagtaccatattacgattcaagatgaaggatttaatcttgggattttgacaatgagaacgccagagggtgtcttccaaacagattttgatgaataaataagtaattttgttacacatccaaaattagcccgcagaacgatatataagccatatttgtggcctcggagcaaatgttgaatagtagcgttttaagcgagtattcaacacgccgcgactaaagtcactaatatggcttatatcggattgcccctgtatggagacaggatatccaatccatgaattgccatgaccccttctacttcttcctcattgcctttaaattcatcaataatcttttccgcactcctttaaacggaattatcggtatcattgatatcaacagcaaatcaagcgatatggaattaatcgaggaaaaccgccaaaaggcacgatgtgccgcacagcagcttttaagcctgttaaatgaagtgcttgacatgagtcgtttagaacacggtgaaacagttcttacaaacgaattgtttcacctttctgaactgaccgccgctctccaggatacgatgcaaattcatgctgcggactccggcattattctcatctgtgacagttatacggttccatccaactgtgaacgggtttatggcagcccaatctatattcagaagattttctttaacattatagaaaatgcaatcaaatacaataaaactggtggacagattcgctggaaaaccgaattaatcgaacagacagaaagcagacttacttacaaatatacgatttccgataccggtgtcggcatgaatgaaacgactgtcactattatcctgccgtttactatcgcaaatgcacaaaagaattcttcagcccatggtaacggcaacgcagattacttaaataatgatgaatttacgccatctatttccgatgaagacatcaccgctgcgtctctttctggtaaacaaattttactcgttgaggataatgagctaaatctcgaaattgcccagtttatgttagaagatgccggaattattgtcacccctgtaaaagatggttcacaagcattaaaagcatttttagaaaagcctgccggtacctactatgacatgattctgatggatattatgatgccggtgatgaatgagcatttaacgaaaccgttgaattgtgagaaactgattgcaacaattgtgaagtttttgtaactggtacaaagttggcgagctgtctttggctgggggcagctggatagttacttagtttactgctagagcgtgtttgaaaaacatatcgctccaacagccaaaaaattcttagaatttttgaaaaataaaaatttttatggagatttttcaggtttcctactataatagtgtttaatatggcttgaacttaactggagaatatttgaaaaagcaaaaagtaatttacacatcacatttgcgagaatggtttttcaaacacgctctagcatgagccatatccgattgtgtttgaagatactaaaatgattttcaatacacactcacattactagaaagataagacgtggtattttacatactgttttgtagtgttacttattgttaaataccgcaactgacacatcagaaatggaggaaacaaagacatggaaattgtttgtttagacttagaaggcgtattagtaccggaaatctggattgcattcgcagaagagactggaattccagagttaaagagaacaaccagagatgaaccagattacgataagttaatgaagtatcgtcttaacattttaaaagaacatggtcttggattaaaagaaattcaggaaacaatcgcaaagattgaccctattcctggagcaaaagaattcttggataaattaagagaactgacacaggttatcattatcagtgatacattctcccagtttgcaggtccgcttatgaagaagcttggttatcctactatcttctgtaactctctcgttgtagcagataacggagaaatcactgactttaaaatgcgttgcgaaaaatctaaatatactacagttaaagctctccagtccatcggttatgataccatcgccagcggagacagtcacaatgatcttggtatgattcaggcaagtaaggctggatttttattcaagagtacagatgctattaaggctgagtatccagaaattccggcatatgaaacatatgatgagttatatgctgcaattaagggagtaattgaagcgtagtttgtgatagacagacgagctatcccctcctatctgtgactttcgttgcggcatgttaaatgttctcatttttatttgcctaaatccaatcactatcaatcccaaagagaaaagctgccctatattgtgacctcggagcaaggtttgggtgcgtgtacatgaacgagcattcaaaccgctgcaaggtcacaatataggacagcttttctctttggatgcgtcagcctattaatgaattaaatagccatccccatctttactgctttttctaaaaattcctgatgattttcgaggtcatctgctcctgcaagtcccggacaaaggagtgttcctcccttatcaaaatgcagtaactcacaaagctgttcataagcatgaacaacgtcattaaacattgccgaatctggattagcagatgctgcaatgagatataaatctttgatatgtaaagtttctcttccctttggaaaactaaactgataaaagcggtcaatcgctgttttaatctgtgatgtaaagccgctccagtagacaggagatgccaatacaagaacatctgcttctcgcattagttcattcattctcactccgtcatctttttgtccgcaacagccacgctgctcacaactcttatctgcatgacagccatttaagttcgcagttgctgcatcaaaaacttctacctcgttccctgcagctaccgcaccacttgcaaatgcagttaccagtgcgttggtgttgcccttcagtcttggacttcccgtaataatcaatacttttttacccatttcttactcctcctttataaagatattataccaccacaaaatgacaaaggcaatttctgagttgcgcagcaaagacaagtttaacacaatatcaattttccaccattgcgtgcaattttcgttctccaaccaatgtctaattcttcatcagatagaatagctgtataattatcggtatctccccattttacaaaatttctttttcccattttagaatgatcaattaaaagataattctcatctgaattttcaatcacacatttttttacagctgcttcaatctcctctgctgcagacgtgccaaaatctggctcataactggtagaaccaaaaaaagctttattataatgaaaacgggacaaatattccgccgtagcatagtcaagaggtcctcctacagaacggtataatcctggtgccatataaagatcaatattttcatctctatatactgactccattactggcattgaattcgtaatgatttttacccgaaatgcaggcatatatgtaaggatttcaagtactgttgtacttgtatccataaaaagtacatctccctctcttataaaagaggctgccttttttgcaattcttcttttattctccgattctttccccttccttaaagaaaaactctgacaacctatattttgtctatctaaaagtgccgctcctccataatgaattgtcgcatagccctgttcttctaataaatgcaaatctcttcggattgtcatttctgaaacaccaaactgattagataatatttttactgtaacctctccatgttcccgaagattatcaataatctgttctcttctctttactccagataattcttttctacattccatctatttttccttccttttatatataattatgaattagccagcttcttccatctgtctcatttcataattattagctatatatttctctttatctatgctatcttaattttactattttttacttttatatttatttgtattttttctgaagttatgtattttgtcaaaatataactctctgtactgatttaatatcacaatttaaatattttttattataccttagcaaaaatgttttatcaaacattttttattccatttttagctaaataaaacgtattcaaacgtttacttctgttctttttaatgatattctagagcgtgtctgaaagacataactaattttattaaaggagacaccacatatgagcacatacaaagctgtttttagtgacattgacggaacactgttaacatcggaacatatcgtatccaccgctaccattgaagcaattgcttctcttcaggataaaaatattccttttgttatcatttcttcccgaagtgcaagctgcatttacccgattttagagaaacatcatttccaatgtccgattgtagcatgcggaggcgcatggattgaggatatgaacggccggattctttcaaatgaaggcatgagcaaacagacagccgctactgttatcgaatttatgacagaaaaaaaattcgatctcgcatggggcatctattccggaaaaaactggattacaaatgacagaacggacgctcgtattcttcatgaagaaagtgttgtggaagtggaaagcgtagagggaactgtcgctttattaccggaagatgcggtcgttaataaaatcctctgcatgtgcaatcctgcgtgtattcttcagattgaagaagatttaaaaaaggcatttccgattctatcaatcgtaaaatcctcaaattacctgttagaaattatgccagctggaatgaataaagccaaaggtatccgcaaattctgcgaactttttagcattgctaccgaagattccgtggcatttggagataattacaatgatctggaaatgctttacgcagccggttgcggtatcctcatggggaatgctcctgttgctattctggagacattccccggaaaggttactcttgataataatcatgatggaattccagtggcactcaaagatttagggctgatttaattcattaggatgaacagaggaaaacgggaagattgctacgtcatatttgtaactttagccgtggcagattgaatgctcgctcacctgctcgcatccaacctttgctccgagattacaaatatgtgtaacaatctttatttctttgccaaaagttagattctatgataaactaaagtgtatttaggaattctttctttaataaaaatataaggagattatattatgaaacttgcatttattggaacaggaaaaatcattgcagatgccttatttgcaatcgaaccaataaaagagattgaaaaaacagctatttttgccagacctcacagtgaagaaaaagcagaggcttttgcaaaacagtataatatcgctgaagtttatactgactatgaaaaactacttacagaaaccgcagcagatacggtttatatcggtcttattaacagtgctcactattcctatgcaaaacaggcacttcttcacgggaaaaatgtcatccttgaaaaaccttttactggcttttataatgaggcacaggaattgcagcagattgcagaagagaataaattatttatttttgaggctgtaacggttcttcacaatgaagtattttacgaaatgaagaaaaatgttgaaaaactcggtacgcttcgtatggctctttgtaattattctcagtactccagccgatatgatgcatatttagaaggggatatcacacattcttttgatcctgcatattatggcggtgcactttatgatattaatgtttacaatattcattattgtgtcggattattcggtgaaccaaaagatgtgaattactatccaaatatcggtccaaatggtattgatacttctggaactttagttctcgtatatgacggcttcagtgcagtatgtacgggaagtaaggattctgacagcccaggatacgtttccattcaaggtgaaaaaggctttatgaaaatcgacagcaagccgaatattgcctctgagcttactaccacttacgttgatgaaaacgtaaaagaacgcgttcgtgatgcggcgggtgctatggttcgtgctacaatcacagattactttactgcaaaagaacagcaccaccgtatgacgcaggaatttttggactttgcaaaaattattgacgaaaaagattatgagactgcacatgagttattaacagaatctgtgactgtggtaggcgttcttgaaaaagcccgaagcaaggcaggaatcaaattctgatttgtagcgttggagaaataaacagacgaaccctcctcccttgtaatctataaaatgcttcgtttcactgcgtccaagctgctcatccgcaacttgaacttgctcaaaggcgcattttatagattacaggggaggagggttctgtgtgtttcaatccttaatatttcatttcatggaaagctataattttatagcaaacatccgctataaaacctttaaaaaatcgaatttaaatactatatttttaatatactgttatcgattcactatatttcctcataaaatcacagtattccgggaaatcccccaattcctccgactgattttctgagctgccaacgagcagaactcctgaagataaataaagcatatttgtggcctcggagcaaggtttggatgtgagcgctgtaagcgaacattcaaaccgcagcgactaaagtcacaaatatgctttatttatcttcaggagttggtctgctccgcagcctcaaaaatcagaattcttcgcacattcttcgcacagcccatgaagtaaatccccactgcattgtaactgaaaatgatgttcttccataatatgttctcttaattcatccataaatccacagtctaaatgcattaccttcccgcattttatacattttaaatgcaaatgttctctgcaatgtcctttttctcctgcatattgatatactgctttatccgagtttatatctgaatatttaataataatattctctgcacaaagtttatcaagaagccgatagacagttgttgtatttacactgatttctttttcttcaagatgcttttttatatcagcggcacttattgtagtggaacaattttctttcagataatcaagaatcactaatctattttttgttgtgtaggattttctttctttcatgatatctggcacttcccttcttctatatcactacaaattattttactcagattctcctctcacgtcaatgttactatttaattcattaagcgaactacagacgaagccattgcccccaataaggcatatttgtgattttagtcgcggcggtttgaatgttcgctctactcgctcgcatccaaaccttgctccgagaccacaaatatgccttattgggggcaatggcttctgtgctgtggctggagaaggtgaattaaacaggaggaggggatttggggacagaagctgatgtcttctacttatttgagaatgactgggaatagaggggatgatttaacttaacttctttatctaatccctttgaaatgaccatagatatgtacatataagttcataaaaactggatttaaaaaattatagaaaatgcatcttttttattatcgcagcaatatttcaataattttgaagcaagaagcaagtttcaattctcctttttaacctttataacttcaatttaaatacaaagcatctgtttacaatagtttcagagcaagcagaaaatttctaccctctcccccaaatctccacaaccactatttaattcaatcaaaatccagccaaagacagcccgagaagagaaccgatatcctatatttgtggcctcggagcaaggtttagatgcgagcgcataaagcgagcatttaaaccgccgcgactaaagtcacaaatataggatatcggttctcttctcgggcgtctgttcttaatgaattaaatagtaaatcaatcttctgtttcgaatttatccatattttctgtttttccgattacaacaatgatatccccggtctggaaatggtaatctggcaagatttcgatgtttgtctggttttcattttcgatagcgataatgtttagtttatattttcggcggatatctgattcctgtacactttttccgattaacatttttccgactggaatctgacgtatttctacgctgttacttaaagatacaaagtcaaggaaattatcggatactaattttttgccaagacggagtgccatgtctctttctggatatactacttccgctccaattttttttaatacagctccctgctcttcactggttgcttttgcgataacgtgtggcaccccaagttctattgcggacatggttgttaagatgctgacatctactttttctccaatacagataatcgcaacatcgcagttctggattcctatttcctttaaagtttccatgctaagattctctgcaacaaatgcatagtccgtatagcggcgtatgttttttattttttcttcgcttctgtcaatggcgatgacttcctttcctgcctgtgccagagcgattgcaagggctgttccaaaacggcccagtccgatgactccgtaggctgttccacgattttttctcatttctatttcctttctttttcggattttctttcaaatttcttatgattaatacatactagagcgtgtttctatatatattttttttgatgtctatttcatatttcagagtaatttactttttatgctaactttcgtgaagaattcggaaatgtgttaccgagaattttctcctaatctctaaattcatcatcaaagatttatttatatctatttttgttaactttatatacattgttttcatctatcttttatccgattgaaatcatttcttcagaatatcttgcattcggtgtgctaactttgccccatacggaaagcagggtaaaggctccgacacgccctgtaaacatcaataaaataataaggattcttgccgccacaccaagttctggcgtgattccagtggaaagtccggcagtgcttaatgccgatgctacctcaaatataatctgtataaagtcatactctggttcaaatacacacatcaaaaatgtagcaacacataaaattccagcagatagtacagtaatcataaatgcttttgaaatattttcttcggaaatgctacgcttaaatgcatgtgctgacttttttcttcccatacattttagagcctgaatcatcacaaatatcgttgtagtctttacaccgccacctgttgatcctggcgaagccccgatgaacataagaatacacattgcgaaaagacctgctttagaaaagtttcctatgttatacgttgaaaatccggcagttcttgttgtcatactctggaaaaatgctcccatccatgtaatattttctgttgcttttaaaatcagggttcctccgattaaaagaacggctgtcatagaaatggcaactttagaatgcaggcaaagctttttaaaacttttttgctttacaatatctacaagtacaaggaatccaattccgccaacaataactaaaacatccgtagttatatttagcagaatattatctttataaggaatcaggttatgcattcctccaagattatcaaagcctgcattgttaaaggccgctatcgaatggaaaatgctgattccaactgcatggagtggggaataatcttttcgaaatacaaaaaagcttataatcgcacccgccgcctcaaagccaagtgtaatcgcgagaacaattcttacgagtcgcaccattccatgataggtgtcaacatttaatgcttcttttaccataaggcggcttttgatactcactcttttacctgctgcaatgataaatcctacaccaacagaagcgattcccaaaccgccaatttgtatgagtgccgcgacgattgcctgccctatcgcagtaaaactgtctgcggtatcaacgacaacaagtccagtaacgcagacagcactcgttgatgtaaataacgcattcaaaaaagataaatgcactccttttttcaaggaaaatggcatcattaatagtactgctcctaccagaattactgcactaaaaccaagtgcgatgattctacttggactttgcttttttaaactatcaaatatttgtttcatcgctccctcttttccgggtacttatttttcttccaaattatttctatcatttactttatctcactttattttcttttcgaattattccgttttattttctttttcaaattatatttatcatttactttattatctttttgcttgttattcttctggttctttttctattttctttcgtgggattttccttacaatcgcataatctaccatatgatttttaatattttctacatcaatttttaaaccatttgcctcaatagaaaacttctctccttctgcaggaactcttccgatcgcatcccacacaaagccactaaatgtatcaaatatttccgagaactcgacattaagagtttctgacacctcatcaagctgggcacagccctgaatcctccacacgccttctgcaattctttcgatatcttctggctttgctggcatttcctcttcttctaactcaccaactaatgcctctactaaatcatgcaatgtcacaataccgctcattccaccatactcgtcaagaacaactgcaaaataaattcttgtctgcttcatgttggcaaataatacattcgctttcatattctctggcacaaaatacggcgtatctacggcatgtttcatcacatattcttttgatttatcttctgatcggaaatagtcctttgtatcaaggattcccacaacatcttcctggttcgaatcaataatcggaaaatgtgaaaaacgacattctctgattgtcttttcccattcctcggcattatcctccaggtttaaacagactaaatcccttcttcgtgtactgacctgctcggcagtcgtatcattaaactcaaatacattctgaatcagtttactttcctcattctgaatcgttccctgttcctttccttctgcaagcatcatacggatttcttcctccgtcacaacttcctgttcttcctccggattaattcctataatccgtaaaagcagactagaagaaacactgagcagtactgcaagtggtgcaaaaatctttgcaaaaaagaacagaattcctaccatcttaaaagagtcttcctctgtcctactcatcgcaattcttttcggcaaaatttctccaaatagcagatttatataagtaagaagcaatgctgctgcaacaatagcagcaacagacattacttgtcccgatacagaaatattccattttgctaacaaatgcatacagcctgcttttaaaaatccaccaatatacactgccacaaaggctccgctaagcaggctggcaaatgtcaccgctgattctatcgtctcaaggaacctcgccggcttctttaacagcattgctgctttctctgcccgcttatctccttcctctgccatctgctttacttttgcttcattcaaggaaataaccgaaatttccgcacttgaaaaaattgcattcaatataagcaatacgatttgtaacactaatacactaatcattttatctaaaaaattccctccatatgtaatagaactcattataccgtgacatcctcccccacctatagaggtgggggcttcccaacctcggcaagtttggttctcgttcgataacacttctgtgctaagcataagcgatctatccccgtgtgtcccacggttgtgttatattgtgttaaggtcatgcatttaccagccgcattccctcatttctgatatttaccgctgcatttacatctctgtcatgatgggttccacactgcggacaatcccactctcttaacgcaagatttttcgtttttgcatttttgtaaccacaaacagaacaggtctggctgcttgcaaaaaatctatccaccttcaccagtttcttaccctgctcctccagtttgtatctcaaaaatgttgtgaacattccccagccgttatccgaaacagatttcccaaatttcaacgaccgtgacattgctttcatatccaaatcttctatacatatgcaatcataggcattggctatctgtcttgactgcttatgcaggaagtcttttcgttgattggaaaccttttcgtgaagttttgccaccttaagcctttgcttattgcgattgtttgaacctttctgcattttggaaagcttacgttgttctctcgctaattttttctctgcattcctgtaataccccggataagcaggctccttaccgttgctgtcacgatataattcatgcatggaaaaatctaaacctaaaaacttttgcatctccttttcctgtacttgatcttcatactcaaaaagaatacttgcatagtattttccgcttggtgtctgacttactgttacagatttcagtctgtattcacttggaacaaacctgtgctgttttaaccggacttggccaatcttaggtaatctcaaatatccattagacagagttatgttcccgttgatgcagagcgtggaatagctgtttttattccgcttttttgatttgaaccttgggaaaccggttttcggctgtttgaaaaagttctgaaatgccgtatcaagatgcctgagcgattgttgtaatgcgatactatctgcttcctttaaaaatccgtattcttctgttttcttcattgcagccatttcttttgcacaaatagtatatgttacgttcgtcttgttctcctcatactgccggatctttctatcaagccaatgattgtataccattctcacacagccaaaagtcttagcaaacaaaatcttctgttcatcattgggatagattctgaatttatatgctctgtttgccaccatgccacttccttttcctcgaaaaccacctgtgatacttgaacacaagcgcaagatgatagtatagtaagaatactaaatgtgcgttattatctcaattttttgtatctcaattttttattatccgactaaagatactatactataattaggatgcactatcaagtaggtagcagacgcaattcatctcccaccttagaggtcggagtcttcttgctgtaagaggataaaagaaggaaaaatataacttctgatttgccgcaggcaaaggagaccctcccaaagagagaccataccctatatttgtgactttagtcgctgcaggttgaatgttcgcttaaccgcttgcatccaacctttgctctgaggccacaaatatagggtatggtctctctttgggagctgtctttggcgattggaggaaaatcagaatttattttttgaggaaagagaaaaatcccttcttctcatatggttcttcttttatatcgaggacttcatatcctgtttcagaaattgctgcttttaatttgtcagagtcaatcgcctggtttgcaacaattactgtctctccctttttatgagaagatgtaaccttttttacattgaatttctgtctaatcgtatcatttacatggctctcacacattccacaggacattccgtctattcttaaagtaagctgtaccattttaatctctccttttataatatagttttcccagtattttaatcggaaaatactattttattataagcattccttataattgaggcaagaggaggtattgagaaaaattatcaggcaattaccttagcttgtcgttggtttaattatatacttcaatacagcaaatcctccatcatcttatccacatcatcatagcccttccccatagatggattttttatttttcaacatctaatggtatttcgtaataatcctctgccttatatgtttcgctgtctcctgccgattttttaaagaatagcaatgcttttatctgttttacttccaaaatcttttttgttgtaactgtttcggtaaattttccatatagtttacctgagctacctgtttcaaattgctctccacttccatctacaacactttcataagtataaacttttccatctttcatctttacgcctgcaaaggaaggtggctgatgctccccattcatgtcagcatatttacagccttttggataatctgaaacgagttccaaacctaatgcagaaatttctgcactgacaagttttacacctgtgtttccaaactctttatttatgtcaaatttctgactttcattagaaccttttaaaatccattccagatttaagaattcattttccatgtactctatttccaatggttcatctgtaaataccgttctttgaccggctcttaaaatatcattacatttgttaataagaatccgggtcatccatgtccgaaaaaaccgatttttctttagcgtatctatcttttcccagcatacaagaattgtatctgaaatagcatccgctacatcttcatccctcgataaaatagaacgggcaaccttatacatattttgcatctgcgattccataagttctgtaaaagcatctgcatccttcctcttcgccctttttacaagacgtgtaatttccataatttactcctttttagcatttaacaattgttaaaataataaaaatcattgttcgatttctgttataaatcacatgtgtactgaaaagctttttgtcgcttctacttattagacgaaagaaaaagaaaaaatgtcgcaagaaaaaaagaaaaactaaaaaatatattaaaaaaagaacttcatcatatattaactcagcaaaaaaactatcgacttcatccacaaatcccttcaaagatagaaaatatataattctgttcaacaaaacagataataaaaatgaatgatttctattcaacaaaaatagataaaaaatgaataatttctgcccagcaaaaaacagaaaccgaaaaataccatagcatcctatctgtggcctcggagcaagtgttggatgcgagcgcctaagcgaacattcaacacgccgcgactaaagtcacagataggatgctatggtatttttcggtttcgtctgttatggaagatttcatctgttataccagtttccgtctgttatagaaagcccccttttgttagcaaatcattttctatacctatatccacatttcctcttcgatccagtccaatgcctcttcataatctttccgtgcttcctcgattttcagagggtcctgtctgtcaaggattctctcaaactgctgggttaccatctcaagctgttctctgagttctcctgtggtttcttcataaagccgttcaccgcgaagaaggaggactttatttttctcctgttctcttggcgggattttaagataagaaagttccctcatgcgggctttcatctcttcttctgtcatgctgttttcctgattctttatgagacgggttacggtctctcctgtggagacgattttagcctcgacttcaagtaacgcattaatatcataagtataagtaatgtcaatctgttcctttccagcctcgttatccgggacggtaagttttaatgttccaagggaaacattgtttgaggcaaatcggctctcgccctgtaatatgtgtatttctacctgtgtctggtgatcgtaaacagtaaaaaagtgctgggttctgctcgccgggattacggtgtttctctcgataatcgggcagaaatgattaccttctaaatggtcattctctgtcttcacagatacttccgttccaagagtaaatgggcagacatcggtaaggatgacttcttttaccggttcttttcgctccttcatcgctgcctggattgccgctccaagtgcaactgcctcatccgggttaatgcttgtatccggtactctgccaaataatttgccgacaaacttacggacaagcggcatttttgttgtgccgccgactaaaacaacttcatcaatttcccgcgcctttacaccagcatcagaaaggctctttcttactggtgttttgatgcgatctaaaagctggctactcatcttctcaaaagcacctcttggaatcagtgtttctactttttccccattaacagatgcctgcatccggtaaaagccatctcctgtggcattgcatttgcttttttctgcctgattacgataataagacttctcttttagtgaaagactttcttctgtaagtccgtgttctttataaaattcctcaacaatcagatttgtaaagtcctcgccaccaagataattatctcctgcaacagcccttacctcaagaatatcgtcaaacagctcaaggatggacacgtcaaaagtgccgccgccaaggtcaaaaacaagaaagcgggtattatcatttttctgataaaggccataagcaatcgctgccgctgtcggctcactgataattcgctcgactttcagtcctgccaactctcctgcctgctttaccgcttttcgttttacctcattaaaatatgccggaacactgataactgcctctgttacttcctctccaagatacacttccgcatcttcttttaaagaacgaagcaccattgctgaaaggtcggttgctgtaaaaattttatttcctaacttaaattccttccggcttcccatacttctcttaaataaatttgcggtctggtctggataaaccgccattctctctaacgctgtttttcctacataaacctgatcattttcatctatgctgactactgatggagtcagtctttctcctaatcgatttggaataatttcaggtccatgttctgtataatacgccgcaagagaatttgttgttcctaaatcaattccaataatcaccgtgtttcctcctgtaatcttgttaaaatctgcgcttttcgataaacaatctctgcccattcctcttcgtccatctccgattgtaaagaccagcctttcttttctaatttttcaagaatggaaagtgccttttctaaatcttttcggctctttgctcttattgcaatatatcttgcccgaagtagttcaagttcatcactgtttgctccattttcttttgccagttgaaggatatctttcactctgtcctgttcgccaaatgacagatacatacgaatcaacgtacagtatggtcttgcatggtatggatacagagctgtcgctctctgataatcattgattacttcctggtaccttccaagatacagacaggcttcctgacgaagcagatatgcaggataatactgtgggtcaagcgcaataattttatcgcagatatcaaacatttttgcatattccttttttctgcgccagatatccgccgctgtatggtaataacttactttttgtgaaaaatcctgctccgcttccaccgctttttctatgtaatccattacttctaaaagactgccttcctgtccatcaagaatcaaatctgcctttgcagaggcaatcgtataatatgcatagccaaggcgtgccatctgtctggtcgttttctttgttccatctggacgaagcttttgtattgcgtgaagccacggaacaagatgttctaacgcttctgcatccttattaaccgttaagaaaattctaccctttaagttgtggtagtcaagataatgctcctcatctggaacaaagccatccatcagcgcaatgccatcttcaaatctggaattctgataatagcaccatgcaagttccataagaccatcctgatctaaaagactatctttatattttggctccaattccgctatcacatacacatttgccttgttaagatctgccacaagccgttcatctaccgggctttcttctaacaaatcaagaatagactctcttgcctctcggtagcgtccctcatgaagtattgattccatctttccggttcttgcaagaaatgattccggatgtgcttctaataccgcatcgtacaatgcaatcgttccatcccatgtatctttttcctgacaatatcgtccatagcagcatacaatccgttcttcctgtggatacttctttgcaagagagcggaaaatttcaccgccctcttcctgctttttcctctcttcatcactgtaaagaagccttgccttttctaataaaatataaggatggcaaatatcataatttgcttctataaaatgatattcttcccacgcttctttccgcataccaagatctgcatactggcgaagcttatggtaatgttcgatataatcgtcgacgtcctcactaacatcaccctcaaataattcataatttaacgcaccattatagcggacaacctgctgcaaaaagtcaacgtaaggctctggaaacagttctaggagttcctttcgatttcctgtaatagaaaatgtctgatcaatctttttccatactggtgatggcagacggaaattctccattaaaaatacaagaaatctctggcgtacttcctcgccgctttctaagctgatacagatatcttctgaaaaaagcttttcccactcctgctcgtcaattctccgataaaaatctttgtaaagctgttcgcaccgggaaataaattcctctgccggagaaagattttctggctcttcttccttttgtctggcgtattttaacgcttcctcataagcttccctcagacgcttaaatccgtccgggtcatcttccggattcaccgcatgaagcctcgcccgatatgctttcttaattttcttttcttcttttgtcgcttctattcctaatgtgttaaaaaaatcattcatctttacaactgtccaaatacttctcctattttatcgttaatgactaaatctgcctgtgaatctctctgtgtcgctgacttattaattaaaatgaggtggcttcccttaaaataatcaatgagtcccgctgctgggtacacaactaaagaagttcctccaataataagaacatctgcctgactaatatagtgaatggtcttggaaatgacattttcatcaagcccttcttcatataaaacaacatccggcttaatcagtccgccgcactcgtcgcattttggtgcaccctcgctgttttttacataagcagcatcaaaaaacttgccgcaccgcatacagtaatttctgtgaatacttccgtggagctctaatacattcttacttcctgccatctggtgaagcccgtcaatattctgcgtcacaaccgcacgacattttccctgtgcctcccactctgcaagcttataatgtgctgcattcggcttggcatcgagtgccatcatcttatctttataaaaatcaaaaaagtccttatttcgtttcatgaaaaaggtgtggctaacgatggtttccggcggaaaatcatatttctggctgtatagtccatctgtgcttcgaaaatctggaataccactctctgtagaaacaccggcacctccaaaaaatactaggttatctgtcccatcaataatttcctttaactttttgattttttcgttcataacatgtacctccttacatcactgtatctatatacttgttaaaaatatttctgccaaaaattacttttcaaacacgctctatatcaaatcataaaaataagcacattcacaagccctaatataaggccaatcaccgctccaagatttacaatcgcaccaagttccttactcataatagaaagtaccagttcctcaacttcttctactttcatcgcattgatccgctcctcaactacagctgaaagctttaaggaggaaagtaatgccggcagtttttcttctatgattctcttataaagcctccagagaaattccgggtcgtaaattcccttttcttcaaagaatcctgttacttccggtattggctttgcctgtaattcttcggatgctgccactacctctttttcgatatagcctctggcattctctgctatgtaggcatcaatcccttcctgaatctgtccggcgattttctcaataaaagaaccgccaagcatcatcccaaacatggaatccgcaagctttctctgtgcctcctgcactaccttatctacgatcagcttacccggctccatcgcaataactttttctgaaaggaagtctgttaaatcttcttcaaccgatgcagcaaaatcatccactttctcttcttccacaatctttactgccgcagaatgaagtgtatcttcagatcgtttttgttcttctacccatgcctgtatatgacttttaaactctttttctgactcttcagaaagaagcttctctcccatatactctggtgttaaaagctgtgtttccacgacattaccaacggcttttgccagccttgcctgtcctcttggaattacgcctggtgtaaagggaagtctctttccaaataccctgacttcctttctcgggcgaaataacatctttaccgcgatccagtttgtcacataaccaataattgccccgataattggtgtgacaatatatttccacatagtttattcctcctttttcagagtacattcaacatatttctgaataattacatattatcatatcctgttgcaaatgcaagaatcaagtcaggattccgcttcttccactttatcattatctaagccattccagaaattctccaaaacctgtccgcagttattccggttcaccgcataatagctctcccattcttccggcaacaggctttgattatccctttctaaaaaacgttcatccattaaaagaatcgttcccacatcttctgctgtccgaatcactcttccagcagcctgcagcactttgttcattcccggataccgatacgcataatcatatccttttttttgctgtctgtcaaagtatgcccgtatgacttctctctcattacagatttgtggcaggccagttcccacaatcagcacgccgataagactgtttcctgtaagatcaataccctctgaaaaaatactgccaagaacacaaaaaccgataagcggcttccctgactgttcccgaaacttttcaaggaaagcttccctgcttctttcttccatcgaaggttcctgcacaataatttccgaaaccagcgcaagattgctttgttctgccatcccatacacgctggtaagcatttcataggaaggaaaaaatatcatatagttccccgcctttttttctaaacaaagttccagataacgaatcatttttccgtattcccactcgcctcgtctcgtatagcgactcgtcacatcttccgtgatggcaagaagccgattctctttcgcaaatggcgaagctatctggtatgcctcaaagcggttaccgccgagaagctgcctgtaatactgcactggcaaaagtgttgccgagaaaaaaatacttgaacggctattttcaatatattcctccagcttatcagacggattcacacaaaaaagccgtaataaaaagtctcgtccccgcttctcactataaatctcataaccgctgtccatactgtctaacatcatatagaaatgcgtaagcttaaaataaaattcaacaatctcctcgcgctccgaaaaattatcgtggtcagcaagatattcttctaagggcccaatcagatgaaaaataggaaaatacatcgcatccacattctcatgtaatctgaaacgggtcccatcttgtgcctgcttttctaactttctgagtgccataacacaattacctagctttttaaataaaaaccggttcctgtccttaaaatattttttcggtactttaaagtcactctttgcaatgtctgcgctatacatctctctcgcccggtcaagcaagttatgggcttcatcaataagataaatattctgccgcagacttccttctataagactctttctatttacatgcgggtcaaatacataattataatcacaaataatacagtccgcccacaccgctgcctcaaaagacagttcatatggacaaaccttatatttttcagcaaataaaagaatattctcccggctgatctcgcactctgcagtaagcagtgcatacagtgcctcgttaatccggtcaaaatgtccttttgctctctcacaactttccggattacactgcatctcttcctgaatacaaattttttcttttgccgtaatcgttactgctgagagaaataatccctgcttttttagcagctttatcgtatcctccgccactgtccttgtaatcgtctttgccgtgagataaaaaatattttctgctttttctgctccaagttcttttagggcaggataaagcgtagaaatcgtttttccaactcctgtcggagcttgcaggaagatgtgctttttattctccatcgcctggtaggcaattgctgtcattttcttttgccccggccgaaaagaaaaaggaaactgcaatgcctgaatgcttgcatttctcttttcccttgcctctacataatacgctgcccacatccggtaagcatccaatacttccgcaaaccacaaagataactctcccatagtataacaataaaaaattctctttatctgctcagtttctaaatgacaatatgtaatttgtacccctatcttctctaaatcctgcttcgctccatacatgtacgcataacactttgcctgtgccaaatgtaaaatgtctgcttcctctatctcttccacatcgcgatatacacatttaatttcatcaacataggtaagtttttcttcattactctctatctgattcatcccatcaacatcactaagcctatccttattaacctctgttttgtcaattccatcggctcgtccttctaaaactaaatcatacctttcttcctgccattccattttcagaggaacttcgctctgataagtcgctttctgcccccgttgtatctttcggtgcagcctgctaccctcaagcattgcctccgggctggcacttaccgaggatcccgtcgtaatatcgccacctcgaaataaaaattctaccagatgccgcaccgaagtttttacgacacctttctgataggacaacataatacagtcctccttctttttggatgctctctaatacttttttgtcattctttcttatttcataaaaattcttttattatttacactataataaattacgtttttcatatttatttcttttgaatgaaatactgtcgtaattttcctacttatcttttctttcctgtctactgttttctccctgtatacagctttttctgatttctttttatttctttccaatgttcccaggaaaatcttttacataaaagaaaatgcccacaatgaggggcaaaactcattgtggacattctccgtataatactaacctttaacttagggattactttaattataatacaatacttctctaaaaatttcatgcctttgtaggggaattttttgttcaattttcaagaaattattgatattcgtattaagataacaacattctttcatttgaaataaaaaattctcttcttatcgtctatgaattcccaaaatcttctcatgaaaacaactacaagaaaattctcaaaacgcatacttcattctcttcaaagttttactgttttttccctgaaatgtatttgaaaaaggcttcttctatttatgataactgtccaagaattgcaggaattaactgtttctttctggataccactcctggaagttctgcggagctgtcttctacggttgtctcaaatgcgttctcaataacttctttgcacatctctcctaccattaataattctgtagattcattaatgatatctgtcatcataaagaataccatatcaagaccgtaggaagtacgaacctcttccatgtaagggagaagttttcctttacatgcagaaagttcttccttattcatggaactgatctgacctacaccaaagttaatgttagaatcattgaacttcttgaaatcctgatagaagatttcttttgcagatttttctcttaaattacttccggcatcaaacatatctcttgcatactgctcaatgtcgatatgtgcgatagatgcaagtttttctgcaacaagatggtcaagtgctgtacatgttggagaacggaacattaatgtatcagaaagaatggcagaacataaaagaccggcaatcttttctggaattgtgacatcattctccatatacatctgtgtgatgattgttgcggtacatcctactggctggtttctgaaatatactggagagtttgtctcaatatttccaagacgatgatggtcgataatctctaagatttctgcttcctcaaatccgtctactgcctgtgccttttcattatggtctacaaggatgagtttctttctctctaaatctaataaattacgtctggaaatcattcctacgtagttaccctgattatctgtgatagggaaatcacggaatcttctctttgccataatctcttgaatatcatccacataatctgttgtatggaaagtaatcaggttatctgttgtcatgaaataacgaactggcatactgtggttaatgagtcttgctactgtgtaagtatcatatggacttacgatgatacgacatccatgttcctttgccatcttgcggatagttttagaaacagtagcacccatacatacaacgatacactgtgcatccatctcaatcgcacaaagctgggactcataacggttaccaagaataaccatatcctgtggctcaatatatccctccatcatatctgggtttgcagcagcgattaaaacatgtccttcttcaaattcaccatctaaatcaccaacaatcatctcaccatcaattgtctctacaatatttttatagcttgtaccagctttggataaaatcatgttgtcatatacatccatgtctgaataagcaatatcactgactgtaatgattccggcaagcttttcatcctcaagaataggaagagaaacgatacgtgcgcctctcataatatcccatgcctttttcagagataatccagcttcgatacctgctgttttacgaatctcaatatctgtaacctgtgggcggatatcattcacatataatggtgcttcctgctcaaagtactttaatacatactgtgtctcttcattaatatgccctgctcttgttgggatatactttgctccctcttcctgtttctgacttaattcattcttaagatatgcataagaaatcgcagaacagatactatctgtatctgggttcttatgaccgattacataaacattattctttttactcaaatcccctatttcctttcctttttatagttattatttatactcgcaattccagaaaatactgcaggcaatctgctgaattgtcttgattacattactttccagtatgctatagtaaaatatcccggtttatgaaaaccagaactccctgcccttatcataccagttattatcacaccttttgggtagttttcccagtatgttcacagacatgactggtagtaaaaaatctcgaactactgtacaaattcttctattcttttccaccatctataattgtaaacaaattttttctttttttcaattgtttttgataagataaacgcttatattctgccctcgaatatcctttatactcaaataccggaacattctcaaaaatctgtcttactgcctgctgtacttcctctcttatctgtgcgttctcaaaggacagaatacttaccttttcctgcagcttttcataagaactgccattctttatcataataagcaatgttcttactaaaaccgttgcccgataataattcaatcccatcttatcaatgaaaagattcccaagctcactgactcctcgccaccgattatcaatccctgccgcatcactgacatacatcagatcttcaagttttatcggcttataaggaagattctcatgctgtctgacatattcaagcagcatatctggattctccacattcagatattgaaaatattcattcttttcgaaagtatcttttaaaatcgctccaaacggccacaaagaagtgcggcacttaataaagagaagaaaatcctcataagaaatgaccttcttagatacttttaaaaacagggaatacagcgttcttgtctctataaatccataataatacatgaagccggtaattatcttttcccactcatcatataccgagagaagctttctgttcttcctactctttaacagaaaataaaaattatccttcatctcttccacaacaataagacggttcggctcatctgtgaccggattgcccatctggtaagctaaaaatccaaaaatttttaaatactcaatataattccagcgttcctctgtcatcgcaatgacagaattctcccagacttctgttaaaaaatctaacattacttttggcaacataaggagaacccacttcggctcggaacaaaactcctctttcaaggcggaaatatatgcttccttcggcagtccatcttcatattcaattccaatccggccaagaattgacttcactgtctgcacaggcgtacttttcataatcgtttctgcttctaaactgctgatgctcactctcgcctcgtctgctacatatctgtcctgcatattctctccaatcttccttgccgcctataagttcactaaatgaaaagcaccctgtaaatacaggatgccattcacaaggcatgccatgcctcatattcattcgtgattattaatttctgccacaacactttttgtacttcttaccacttccgcatggacatggatcattacgtccaatcttaggtggcttaactactgttgtagagcttctctgctccttatataactccttacgtctttctggagttaaaagagcatcccactgctctaaaccatataaccagtcagccttagcagctaccatattatagtaaagcttctctttatcataatctaaagataccactgtatctgcttccatctcctcgataggatttggattcttaagactgtcattgattccatctaagaaacctacaaagtaagtaagttccatgttatatttctgtgccagttctgtaactgttccacttactggttcttctggtgtagcaagaatctgttcgtatactgccttctcctgattgaaatatccaatccagaattcctgtccttctctggttctatcatcatggctatacgcaaattctctccaatctgttaataaagacatatctcttttcctttcttttcaaacgattcccataattcgcggggaaatatccatattcggaactatggcatcatatattataacagtataccaaaatctatctagaaattcaacatatattttctaatttcgtttatctgtttaaacagacgccgccatgaagtagaagaagctatatttgtgactttagtcgcggcgtgttgaatgctctctttcgcgctcgcatctaacacttgctccgaggtcacaaatatagcttcttctacttcatggtggctgtctttgcgaaagcagcagccttaacgttcactaaagacagccctccgaaagataaataaagccacaaatatgctttatttatctttcggaggacgtctcaggagtctccccttgtctgcatcaattactatcttagaataagaacacctttccggagttgttatcgttaattacatagtatgcggaagcatcttctggtttgaggtaaatctttaaagacttgatatcgctttctttatgtccttcttctacatactgctttttaattctttctgtgattacagctaaattagactcattgccctgatactgtacatatacttctgggtctgctgcagcagcttttacttctgctactttttcttttacagtcttttcaactttttttgtaacttcttttgctttatctaccactttagcgccagtatcttttactgtttcctttgctgctgcggctacttctttaatatcagcttcaactgctttttcagcctttggttctacttccttaacagctgcatcttttacttcttcttctactgcttctgctgcttttgtagtagctttagctgctgtagctgcctttgctgctgctttcttctttgctgttcttgctgttgttcttgccataattagttcctcctaaattattagatataccttctaaaatcttttaaaaaattctgaaagtagattaaggtttgtttagtacatactttgctattatacatcggaaatattattttgaaaagtagtttttccaacttcttactaattttttctatagtaattctacaaaataacattattttttatattttatgaaaaaattatttaaaatagtatcatatttttacgagattttgtaaaatcactatagttcccggctgttaaaattaaaatatcaaaatgttagttataaaaaaaataagtccaatgtttattcctttatgctttctattacataaaaaaaacagcgctaccaggattcgaacctggaaatgctggaatcagaatccagtgccttaccatttggcgatagcgctatatactataaaaaatatttaattatagaagcacgagacgggattcgaacccgcgaccctcgccttggcaaggcgatactccaccactgagccactcgtgcataaggtatgtaccttcaaaaccacacacaaactatctttttctatatccaataactctctaaggtcaagctttcgaccgattagtaacagtcaactccatgcatcgctgcacttccatctctgccctatctacctcatcgtctctaaggggtctctcactctttcgagtatggatatctcatcttgaggggggcttcacgcttagatgccttcagcgtttatcccttcccgtcttggctacccggccgtgccattggcatgacaaccggtccaccagcggacggtccatcccggtcctctcgtactaaggacagctcctctcagatatcctgcgcccgcgccggatagggaccgaactgtctcacgacgttctgaacccagctcgcgtaccgctttaatgggcgaacagcccaacccttggaacctgctccagctccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctactttcgtacctgctccacccgtcggtgtcgcagtcaagcctccttctgcctttgcactctctggatggtttccaaccatcctgaggagacctttgagcgcctccgataccctttcggaggcgaccgccccagtcaaactccccgcctgacattgtcccccgcccgggtcacgggcgcaggttagaaacccagtactgcaggggtggtatcccaacattggctcccttacagctggcgccataagttctcagcctcccacctatcctgtacatgcaataccgaatcccagtatcaggctggagtaaagctccatggggtctttccgtcctggcgcgggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcaaaccttcgcttgcgctaagctctccccttaaccttccagcaccgggcaggcgtcagcccatatacctcaccttccggtttcgcatagacctgtgtttttgctaaacagttgcttgggccatttctctgcggctgcttgcgcagcactccttctcccgaagttacggagtcattttgccgagttccttaacaacacttctcccgccggccttaggatcctctcctcatccacctgtgtcggtttacggtacgggcccttgctacacgatagcggcttttctcgacaggaaggggccgcagcttcactacttcatttcgctccgcatcacgccttcgtcttatgcagggcggattttccaaccctgcgactccttcgcttgcaccgggctttccattcccggctctgcttcccttcccgtgtccccgcagttctgataacaaggggtgcaggaatcttaaacctgctgtccatcggatacgcatctctgcctctccttaggccccgacttacccagagcagatcagctttactctggaaaccttggatattcggccgcaaggattcccaccttgctctcgctactcattccggcattctctcttcttagcggtccacatccccttccggtaatgcttcgctcccctaagaatgctcctctaccaacccttacaggttccgcggcttcggtgtggtgtttcagccccggacattttcggcgcaggacctctcgaccagtgagctgttacgcactcttttaatgaatggctgcttctgagccaacatcctggttgtcttagagatcccacatccttttccacttaacacccactttgggaccttagccggcggtctgggctctttcccttttgactgtccaacttatctcgtacagtctgactcccatacaccatctgtccggcattcggagtttgatattctttggtaggctttgacgcccccgcggaaattcagtgctctacctccggcagacttgtatgaggctagccctaaagctatttcgaggagaaccagctatctccgggttcgattggaatttctccgctatccacacctcatccccacccttttcaacggatgtgggttcggtcctccatcgccttttacggcggcttcaacctggacatggataggtcacccggtttcgggcctgcacgtactgactaaaacgccctcttaagacttggtttccctacggctccgacctaagtacttaaccttgccagtacccgcagctcgccggaccgttctacaaaaagtacgcggtcgtacctgagaagtacttccacagcttgtagacacagggtttcaggttctctttcactcccctcccggggttcttttcacctttccttcacagtactatacgctatcggtcactgagtagtatttagccttacggagtggtctccgctcttcccacagggtttcccgtgtcccgtggtactctggatcctgccgggtcagctctggcttcggatacggggctctcacctctctggccggctgttccaaagccgttctcctgccgttactgaatcccttatgcagtccgaaccccgcgatgcacgcatcacggtttgggctcttccgcgttcgctcgccgctacttacggaatcgatgtttctttctcttcctccgggtacttagatgtttcagttccccgggttcccttccataagctatggattcacttatggatgactgtagtcatacagccgggtttccccattcagagatctccggatcaaaggatatttgctcctccccgaagcttatcgcagcttatcacgtctttcatcggctctcagtgccaaggcatccgccctgcgcccttcttcgcttgacctttgtatgtccatttcctaagaaatggctgcctcctgttcctcctagcgtagagaacattcggcgtatgagttaaaactcatgttttcgtctttcgacttgctattgggagaattgatttagtctcaattctttcttatcatagaaatctgatgtcgcttttcttttaagaaaaactttctgtgtgcagttttcaaggtacattatcatgcggtatcccaactttatcaagataccaagtggagaatacgagattcgaactcgtgacctcctgcttgcaaggcaggcgctctccaactgagctaatccccaagggaatccggcagccacctgctctcccatgccgtctccagcatagtaccatcggccgctcaggtcttaaccatcgtgttcgggatgggaacgggtgtgtcccctgagcgcatcgccaccggaaatatcttatcaagtttttgcttgataactgaataacaaaacaactctctacttgtcttccttagaaaggaggtgatccagccgcaccttccgatacggctaccttgttacgacttcaccccagttaccggctccaccttcgacagctccctccaaaaggttgggtcactggcttcgggcatttccgactcccatggtgtgacgggcggtgtgtacaagacccgggaacgtattcaccgcgacattctgattcgcgattactagcgattccagcttcgtgtagtcgggttgcagactacagtccgaactgggacggcctttttgtggtttgctccccctcgcgggttgcctcactctgtgaccgccattgtagcacgtgtgtcgcccagatcataaggggcatgatgatttgacgtcgtccccaccttcctccaggttatccctggcagtctctccagagtgcccagccttacctgctggctactgaagataggggttgcgctcgttgcgggacttaacccaacatctcacgacacgagctgacgacaaccatgcaccacctgtctcttctgtcccgaaggaaaactcccattacagagtggtcagaaggatgtcaagacctggtaaggttcttcgcgttgcttcgaattaaaccacatgctccaccgcttgtgcgggtccccgtcaattcctttgagtttcattcttgcgaacgtactccccaggtggaatacttactgcgttagcggcggcaccgaagcctatacggccccgacacctagtattcatcgtttacggcgtggactaccagggtatctaatcctgtttgctccccacgctttcgtgcctcagtgtcagtaacagtccagcaggccgccttcgccactggtgttcctcctaatatctacgcatttcaccgctacactaggaattccgcctgcctctcctgtactctagccgagcagtttcaaatgcagctccggggttgagccccggcctttcacatctgacttgcactgccacctacgcaccctttacacccagtaaatccggataacgcttgctccatacgtattaccgcggctgctggcacgtatttagccggagcttcttagtcaggtaccgtcattatcttccctgctgatagagctttacataccgaaatacttcttcactcacgcggcgttgctgcatcagggtttcccccattgtgcaatattccccactgctgcctcccgtaggagtttggaccgtgtctcagttccaatgtggccgttcatcctctcagaccggctactgatcgttgccttggtaggccgttaccctgccaaccagctaatcagacgcgggcccatcctgtaccaccggagtttttcacacaaggagatgtctcctcgtgcgcttatgcggtattagcagccgtttccagctgttatccccctgtacagggcaggttacccacgcgttactcacccgtccgccactcagtcaccgatcgatcatccgaagaatctcaaaaggtgcttcgttcgacttgcatgtgttaggcacgccgccagcgttcatcctgagccaggatcaaactctcaaataaaatgttcaagatgtcagatcaaggtccagaaccactggttcttttcctgtcattactgtttatttaggttttgaactttcgttctgttccatggactttcctgcagacatcactctcaggaaaacccgaatgaaatttgaattaacgttcaaggttgttttgttattcagttatcaaggtttttagctttctcttacgaaagcttttatattttatcacaccactttgttcttgtcaagaacttttttaaaaacttttttcatcttctttcgaagatttttgtttttcgcgatgcgaacttttatatattatcacatgatttttaatctgtcaagaagttttttcgttttcttttaggattcttgtcatttttctttcaaaaatgagtttctcatgtgcaacgcatattatattatcataacagtagagttgcgtcaagcattttttgaagatttttttattttctcagaaagtactagatattgtacttttttgtatttttccacttataatacacattctctttgctatattgatatatttttatcatttttattcaaaatagcttaaagcactttattggcgtacaatctataacgttttccatttaaattgattctatcataactccctttatgataaagtaatattttaaatctaatttttcgtatgctgccaatataattatcactccccttcgggtttacaaatttatattaaatcaattaaaacttttccctctcgtaacgccttttgtagcaacttttcaatttttgctttttctgctggaagcactaagatctttattgtttttctgattccctcgaaagttgctggatacacttttcgcagatttcttccggcaaaataaatctctctcaaatgctcattttctgcaaatgcttttttccctatggaatgaagctttatatcatcaccttttcctaaaacaattttttccaatcgtttacaattcataaatgctccatcacttattatacggacacagttgggcaagataagcgttctcattttaacacaattacaaaacgcccggattgcgatttcttctataaaataatagtaatctcctatctgcactcgttctggaatctgtatctggctggcatcttgtgtataagacaacagacggacacttccattcgttattgatggatttaaaatctgataactgtttccatctacttcaaaaacttttccgacaggattggaaaaatcccagcttgcgtagattttttcgttttgtgtcactgtttccggatggatattccactgtaaagtgtaccctttttttcttagtacaggatagtctattatgtctccataatgatagattttttcttctaccaggcgttcttttagctgttcataaatgctcaccttatattcattataaacagaagaaaatacagcatgaacctctgtgttttctttaatatgatcaaatgtattgtcccagccattaaatatataatgatatacttcatcttgctgttttgccggaacttctggctcttgtgctgcctgtccatacagaacattttcttctttcaaaagggttccgttctcatgaaaaaagcgtaccacaaaagaacgctgccgctcctcaaagacggcctttgccatcgtgtctttttctatatgggaaaggtcattattccatcctttaaatatgtaatagtactcctctgtctgcggtttttgcgggcgatagggctgtgttgccgcctgcctgtaaggaactgtctctgttccaagcatcttgccattttcatggaaatacatgaccagatattctttcggtacttccttatagactgcctttactacaaggttttcttttacactggaaatgtctttatcccatccctgaaactttatctcatgatgcacagactccccccgtttttcaggcatttcaggaggaagagccgcctcttcgtgagaaacaaaagaagtctttaagacattgccctcttcatcctgaaatacaacaatatgcttttttgctttctttgtttctgccaacgtcatttcctcctgcaaaatatcctattctttataatttactttttagtatacaataatatcgtaagatttctcaaaaacttccccagctttcaatgcattaatacctggtttttcagaaagttcgccctcaaatcctctgttatcacagcggccgcaccacggttctaagcacacatatggcgcacctggttttgaccagattccgaagttcggaaatcctttgctttctaatgcaatatatggttttccatcaggaagtgcaagtgccgcccactcaatctgtccattgtcaaatacgagagcgtctttatcaaacatatctttttttaatgcatacttactgtttgttaattttaattcataagttttatctgcgattgccgttccactttctgtgtctaaaagaacataggaaaggctctctgttccttccttaaaagcaagagaataatcttcaaaatcagtatctggcaatacatttacattaaatgcaggatgtccgccgattgtaaaatacatttctttatcgcctgtatttgttactttccattctacagacaaacgtccgccctgtaatctatgtgtgatttctaacttaaaatcaaatggatattctttttttgttgtctcattcgaacttaaacgataagtcacaaaatcttctcctgccgctacctcctcaaattctgtatctctcgcgaatccatgctgacccattggatattctttgccattataagtaaaatatccgccataatactttcctacatttgggaaaagtacgggtgcatgacggttccagaatgtcgggtctgcctgccatacaagttctctgtcattctccttgtcatagatactgctcagttctgccccatgagcagcaattgttacggataacttttcgttttcgattgtgtaagttgccattctgtttccccttttcatcagtttttatttgtaattgacataaaaaagcccggcagacctgttaatctgccgggtctatttaaagtatatcacatatgccagactaatccaaatcaaaaagctgtcttggctttaagcttattgaagcccaggtttctttgtcggcttttgagccgtacaggatgactgtactttcatagagaatctggttattcctacctgttaactatttatttaaaaatttaccatatcacctatttgattgtcaattataacttcaaaaaaatgtcaaaattgtgaaaaatttaaagacgaagctgggagttatccttttttctgaaagacgtagtaaaactgctcggacgtctgttgttaatgaattaaatagtaaaatcctgttgattttattcctcatttatatgataatattcttggcagatatcctccgtgaatctgacctttaatttaaggagaatcgaaagatgaaaaaattaacaagacaggagaagcatgagcagtgtatccgtgaaatccgtggaacgctagtcgttgtcgcaatctgctgtgtatggcatatttccagtgcatttttactgaatggaaccgggctttattttcttggtatgccggcatggtttagtgtgtctactttgggaacgattgttctttctctccttggagtatggtatttactcaagaaagtattcattgactttgaatacgaggatgaagaggaaggaggcgaggaataatgtccgcaagtcaaaagatcattcttactatttttgttatttaccttgccttaaatgcgattatcggtattgtatttagtaaacgtcagggaaataagcagaacgtatcatctgaaaagaagttttttatcggcggaagaaatatgaacggtcttcttctggctatgacaacaatggcaacctacacttcggtaagttcctttatttccgggccaggtgcggcagggcttacttatggatatgcccaggcatggattgccacagtgcaggttccggttacttttttagttttaggtgtgcttggtaataagctggctatggtttcaagaagaacaggagctgtcacagttgttggttatttaaaggcccgttataagagtgatgcgctggttattatcacaagtttacttatggttgctttctttatggcacagatgatcggacagtttactggcggggcaactttgatttcttctattacagggcttaaccatgttgtttccctcttaatttttggtgcggtagtaattatttatacctcttttggcggttttagcgcggttgccatcacagatacaattcagggaattgttatgtgtatcggtactttcctgtttattttctttgtattaaaagcaggcggcgggctttctggtattgatgccggacttgccagaaatcttcctggtgtatatgatgatcttttttctgtgtacactccgggtactttgattagtttctgggttctcgtaggatttggtactcttggacttccacagactgcggttcgttcgatgggatttaagaatacaaagagtcttcattctgcgatgtggatcggtgcgttaacctgcagtttcatcattgttggtatgcatatggctggtacatgggctggcgcattagtagatacaaataatcttcctacttccgattattttattccttacattgttcagaagattatgccagtaggtcttgcaggaactttccttgccgctcctatggccgccgttatgtctacagccgactctcttctgattctcgcatccgcggctatcgtgaaggacttatggcgtaactatgtggtaaaagataatccggaaaagattgcttcttacaataaaaatgttggaaagttaagtacactcgttacttttgctttcggcgttgttatcattttactgacaatcaatccgccagatatcattttcttcctgaatctttttgctttaggcggcctggaatgtagcttcttctggcctcttattggtggattattctggaaaaaaggaacgaaacaggcggcaatcagcagttctatcggtgcggctgccacatatgtattctgttactataatgtacacgtagcgggaattaatgcggttgtgtggggactgctcgcgggtgcgatattgtattttgctgtaggaaaagccacgagcaagaatggactggatgcagatattattaagaactgcttctagagcgtgtttttctaaaaacagacgaaaataaaaagggactatactatcaaatgtgactttagtcgcggcggtttgaatgctcgcttacgcgctcgtatccaaaccttgctccgaggccacatttgatagtatagtccctttttattttctgtttttcaaaaactcctttatactgttgtttaatataatatctgcatcctatcctgtgaggacgagtaagcaaatatcttgtaagattcctcaattccttcacagacagaaactaagaaacaatcactctttacagatatctgcatactgtcctttggtgattttcagcaggtcatctggtttacattctacctgtgttcctatcttgccgccgcttaccatgatgactggattgttttgtgcagtttcgtgataggtggtgacaaactgttttttcattccgactggagaacagccgcctcggatatatcctgtaattttgttaatgtcttttacatgaatcatctcgatggattttgcacctacggctttggccgccttttttaagtctagttcttttgctacagggagtacaaatacgaagtattcctttttattgcttacagttacaagagttttaaagacataatcaggattctggcctgttaattctgctaccgtcactccatctactgcctcttttccatgtggataataatgtgcttcataaggcactttttctttttcgagaatacgcattacgtttgtttttagttcttttttcatgatgtcaattaaaacgttacttaaaatttattaaaggttataaacagtaacttactcctttcttatttttattatcggactagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctagagcgtgtttgaaaaatccagggattcttgcttcgaccataccagttattattacacctttttctctgtatctccacaagcgttacttcgatgaattcttcatctactatatttattcttatcaatcaaaaattcttgtaatatcctgataccgattaatcactcgataaatctctacaaactcattgctcattttataaataatcacataatcttcccatattgcatatttatagtctgttcggaaactgactcgttttgaaagatctgctcccattcctggaaacatatgtaggttttcgaatttgccataaatttcttttatggtctttatagcatattcttcgttatcttcagcaatgtaatccttaatatttttcaaatcttttgcaacaattggattaattcgcagctttagcatcttactcctccacaagtgtcttcaactcgtctaaatccagccatcctttgccatctttcactgcttcttcggcttcctgaagtttcattagaagttttttctctgcgcgctcacgctcataatcttcaatatctataactacaaaacgtcctctgccattcttagtcagatataccggttctcctttgtggcattttttcaaaacttcattataatttctcaaatcagatactggtaaaatacttgccatattccttcagctccttcctttgacctcatactttttctgttacttttattatacacaaaaagctgtaaaattcaacgtaattttttacagcttaaattgtatctttttcaaaaacagaaaactggctaagcgtttaattccttcttaaacttgcggatatattcttttgccacatccagattataattattttcttccataagttcaatgaaatgtgttccgacaatgcagccatcaatcgtatcttttaatccggctacgtcttctgctgtgcggattccgaatcccatcatgaccggaatcttagatacagcttttacattttccagatactttcttacgtttttatggaaatgtgctgcctgtccggttacacccatagaggatacgcaatagacatagcctcttgcattttctaagatcattgggattctgtctgcggatactggtgcgacaagctgaatgaggattggtgcattttctgtgttgtcgagtgcttctactaattcgaactgttcttcttttggaaggtctgggatgataagaccgtctacgccgacttcggcacatttcctggcaaatgcatctacgccgtagtaaaggatagtgttatagtacatcataaatacgagtggcacatcgcagtcttttcttacctcttctaccgctgcaaatacaccttttaagtttgttcctttacagatggaacgataggatgcatcctggataaccggaccgtctgcggttggatcggaaaatggaattcctaactcgataatatcaattcctgcttctgcctgtgctttgattaaggcttttgtgccttccatatccggcagaccggcagtcatatatgtcacaaatgctttttcatttttattttgtaattcttccattcttttttcaatgcggttcatttttctatcctcctcttttatttatctttaaaatactctgcaatcgtatgtacgtccttgtctccacgtccggaaaggtttacaaccataatctggtcttctgtcattgtttttgcctttttaaatgcgtatgctaatgcatgggcgctctcgattgccgggatgattccttcttcgcggcaaagctctcttaatgcctgcattgcctcgtcgtctgtgatagaaacgtaggttgctcttccgctatcgtgcaggtaagcatgttccggtccaacccccggataatcaagcccagcggagatggagcttgcaatctggatatttccatcctcgttctgaagcaggtaggagcgcattccatgaagtacacctgcttttcctgaggcaaatgcactggcatgttttcctgtctctattccgaatcccgctgcttctacaccaattaattctacgtctttttcatcaatgaattctgcaaacattccgatggagttggaaccgccgcctacgcaggcaagtacgcagtctggaagtcttccttctttttcaagaatctgtttctttgtctctacgctgataactttctggaattcctttaccatctgtggatatggatgagggcctaccgcagaaccgataatatagaaagtatcttctgcatttttcgcccatgtacgaatcgcctcgtttgtggcatcttttaaagtacggcttccactctttacacattctacctttgttccaagcatttccatacggaatacgtttaatgcctggcgttccatatcttcttcgcccataaatacggtacattccatatcaaacagtgctgctcctgtcgcagtagccacaccatgctggcctgctcctgtttctgcgatgactttctttttgcccattcgttttgctaaaagaatctgtccgatcacattattgattttgtgtgcaccggtatgattcaagtcctcacgttttaaataaatctttgtgccgtattttttagaaagcttctctgcgaagtaaagaggagtctctcttccgacatattcttttaaatagtagttatattcctcgataaatttcggatcattaattgcctcattatatgctgtctctaattctgctaatacactcatcagagattctgctacatattgtccaccgtattcaccatattttttattctgcataataaaatcctttcatcaatcatgtaccattgttactattgttcttattttttctggatcctttccgtggaaagttccatcttcacttgttttttctaccgcggaacttaaatcaattacgtctggagccacttgtgaaattgccctttttacattcgtttcatcaattcctcctgcaagaaaaatcatttttttgttttttttatgagaaacatctttcgatgcatctgtcttttgtctttgtctgatattatcaagcagactccagtcaaatgttttcccacttccaggtgtcttgctgtcaaatacatagccttttattttgtcttttgcttcgtattcattcagtttgtctaaatcagacacattaaatgctcttaaaatcggaagcttgcattgtttatatacatcttcagtaaccgttccatgaatttgaatataatcaaatccagctttttcaatttgccttatctgctctgttgtcggtgagacaacgactgccactgtccgaatttttttatctactttttcaagcaaatgttccgcctgctctattgatatatttcggttgctttttggaaaaaataaaacaaatccgatataatccggcagataagtgttgactgccttaatatctgcctcacaggtcattccacatattttaattttggtatggctatttattagctctttatccatcttacaaactctctatcattcctctttaatcagcttgatttttattcttttttgacagattacaaattctgttatcagatttgttcttcactgccttatattttattctcttacttttcgttatataggttcttccattctgttgcaagttctcttggatgttccgatagcataaatgcaccaccaatcaagagcgcatctactttacattcctttaaaaatgcaatatgctcgttcgttgtcacaccactttccgaaacaaataccgttccttccggcaccatcgggcgaagtctctttgtattttcaagggaaatggtaaagtcttttaaattgcggttatttacaccgatgattttcggctggatttttaatgcccgccccatttcttcttcatcatgtgtttctactaatacgtccatccccagctccgttgccagcttataatattctgccatctgctcatcgctaagaatcgccgcaataagcaggatacagtccgctccaatcacctttgcctcatagatctgatatggatcgataatgaagtcttttcgtatcatcggcaatggagaaatatttctgatttctttaaaataatcggtgtttccgaggaaatggtcttcctctgtcaggcaggaaatggcatcgactgatatgttatattcatcaattctgtccataagttccatcgtcatctcgatttttcccatgctgggagatgcctttttaaactctccgataatggataatcccggctttgctaacgcttcataaaaggaaatgctttttctttctgaaacaagggcaagttctttcatttgctcctcgctagtgcgggctttatgctcttttaagcgttttttcttgtcttctacaattacatctaaaatcatcgtttttttgtcacctcttttttaaacacgctttagaaaaattctctattatttttattatggttgattattacaattccagaaagttctctatcatcttttttccatgatctgtataaatagattctggatggaactgaattcctatcaatggatattctttatgctgcatcgccatgatttctccatcttctgttcttgctaatatttcaaaaacgtctggcagtgttttttcgtctacagcaagggaatgatatcttgccacatgaaccgggcttgggattccctcaaaaacgctctttccatcgtgttcgattaacgactgttttccatgcatcagttcttttgcatgaatgatttttgctccaaatgcagctccgatgctctgatgtcccaggcagatgccaaggattggttttttcgtgtaaaaatgttttactacgtccatacaaattccggcttctttcggacttttcggtcccggtgaaagaacgattctgttcggatttaactgctcgatttcttcgattgtaattttatcatttcgaacgactttaatatctttttcaaagattcccatgtactgatacagattataagtaaaggaatcgtaattatcaattagtaatatcataaggtttcctcctgaaatagagtatttctcaaacacgctctaatacgctgcacatctttcttccgactcaaatcctcaaggtaccagaaccttcgcaagagcccttgctttattgcagcactcgttgtactcgctttctgggttactgtctgccacgatacctgctcctgcctgaatgtaaactttatcggcttttttaatcattgttcgaatcgtaatacaaaaatccatgtctccgttaaaatcaatgtaaccaattgctcctccgtaaagtcctcttcttacagattccagttcatcgataatttccatcgcgcgaacctttggcgcaccacttaatgtacctgccggaagaaaggcatttacaaggtcaagtggatgatattcgcctttttttcttccttctaccagcgaaacgatgtgcataacatgggaatatttctgaatatgcatgaagtctcttacctttaccgttccaaactctgcgattcgtcccatgtcatttcttgcgagatcaacaagcataacgtgttctgctttttctttcgggtctttcatcagaccttctgcaaacttctggtcttctgcatcatcttttccacgaggtcttgttccggcaatcggacaggtcagtactttgttgtctttttgctttacgatcatttccggagaacttccgataatttcaaattcttcaaagttgaaataatacatatatggggaaggattaatttctctaagttccttatataaatcaaaacctttctgcttcgtctcaatcgtccatctctgggaaagtaccgtctggaatacatgtccatctataatatactgtttaatcttatttactttttcactatattcttctaaagtatctgactgctttataatctttccatccggctgaaactctgacttctcatctttccgaatatttgcaaacgcttccttcaccatttcttcacagcggaacatcgcttttttccttcctgcttctgtatcatcttccacaacaaccgctgtcattgtctctgcaaaatggtcaatagataaaaactctgtcacaagcatcaatgaaatcgtactgattccaatctcatctggattattatccggcagctcctctttataccttacaaaatcatagccaagaccaccaacaagaccgcctgtaaacgcaagctgctcatcatccttacgaatctcgaaatcactataatatcctttcaaaagatctacgggattgccgctaagctcctttgttgttccatcctccttctcaataaccagcccattttctttactcttaatgacttcctctggattctttcccataaagacgtaacgtccgttattcttatcataactttccagaagaaatccctttttctttcctacaaaactttgataaatctgtactgctgtctcatcaataagactgactgtcttactatatgctcttcttattcgtttcatttgtacccccttcttttctgtaggctgctttatatttttatgttgtggaagctttttgtggcattaaaaaagtccctgacgttcataaaaaacatcagggacgaaatattccgcggtaccacccttattaatcacttaaaattattctttaaaaatctttttctacctttccactctctaaacttcaaagtaaaactaaaatcttctggaacaattctatgtcattctctctaaatccgatacggatcagatgattcttcaaatcctatacagccaccaaatataaactatatctgattattctatagtatctataaacgattctataaaacaagctatgctgtactgttcttacaatctctgtcgatatcctacccctgtaacgcgaggacgcggcatcagctactgttaattcaccttgcatctcccaaatccattcccttttccctcacatatcggcttccacctaatccgactctctggtatgctgtggataaaaggtactacttttgttcaacgattttcctacagtcttaatatgttttacagtatagcaacttttacgctttatgtcaataaattattttaaattagtgaggaggtgggaataaacagacgaagccacagcccctatgctatgcaaaaatgcttcatttcgctgcgtccaaactgctcaaccgcaatttggacttgttctaaggcgcatttttacatagcataggggctgtggcttctgttttttctaaaccctacaaattctttccgattctatgtattccatccccacaaattaggggtgatagatttgaggaagtgaattggagcattatctcttggggagcgtctaccttgcctgcggcaaaccagaattccctaccctcttattgtagttaaaagtgcatcacacacaccttctatactatattccccgcttccagcagtaaggaaaatgctatctccctttttgtaagatacgctctcaccattgctggtgatggttccttcgccgtctaaaacgagaatgctcaagaaggatttttccgaaacagttccctcaagtttgttaaaggttgttccatcgaggttcagtttgtctactgtaaagtagtcgcagtcagcgatatgtggataatgactgtcatcctttttcgctggtgcacagttcgttacagcaacggctttctcgatgtggagttctctcttctttccgtcctttccaactctgccataatcgtatacacgataagttacgttggagttctgctggatttctgcgatgatgagtcctttaccgatggcatgaattgttccagcttcgataaaaaatacatctcctttatgaacaggtactttattcagtacttcaagaagagtgtcttcttcgattctttttgtaaattcatctttgctgatttctctgttaaatccgtggtagaggcaggctccttcttctgcatccactacataccacatctcggttttgccatattgcccttcattttttaaggcgtactcgttatctggatgtacctggatagaaaggttgtcctgtgcatcgatgaattttgttaaaataggaaagtcctcaaaacgctcgcagtttgttccgagtactttctttccgtgttcctcaatatactgtcttaatgtcttgccagcatcttcgccattggcaacaaagcttggaccgtctggatgacaggataattcccatgtctctgctaatcggtcgcctgtcatttcttttccgtagttgtctacgagtttatgtccgccccagatgtaatcttttccgcttggttttaattttaaaattgccattttcgtctccttttagcaaaagtatgttcatattttctgaatcgtttcagtcagaatcattataatacttccatcgtaaaatgttaaggtcaaaaggtattttgtccctaacttgatgtcactgatatttactttttaaacgctctttttaacacgtcaaaaaagcttaaggagcgaaccatatggtcagatggaacataatttcttaccgcacgaagaagttcttttggtttctttgctgcaaaggtaaaggttccgcttttttttgtctgaatggcgaagcgaggaatatatttgcccttaaacataacagatgctatgacataatcaacctcttcccatggaatctggatatagtcattcatctttttttcgttataatattcgaaacctctgtcgccaatcataatttttccgtaattattcattccgtgaaaggaagtggcatccataaccagatccactttagtattgagtgattgtgccattatgcatcctcctttgtatacataacacagcaagggctgtgcaaaaatatcggaaatatttttgtcacagccccctttgtattgcttattccgctttaattaaacttaaattacagaatacctactacatgtcctaagatacctactacaaacaatgcaaggatgattacgataggagaaactttcttcttgagtaaccacatacataacagtgtcagtaataatggcataagacctggaattaaggaatttaagttgtcctgtaaagttgtaacctttgtaggctctaaagccattccggaagcatactgggaaattgctgtcttaataccttctgctcctgctggaaggctgttccagtcaatgtaagcaccatcacttaattttacttttgatacaactggaataaagttgatacttacccagcgttcgatcagcgaaccaagtacgaacataccaagaatagaagcaatctttgttactttctgtaaaagtccaccggaaaggtcttcagaaatcttgctaccagcccggtaaccaaattcctgtgtataccacataaatgcccaacggattacgttccataatacgaagaacaagattggtcctaagatgcttccgcccatagcgagggatgcacctaatgcaccaagcattggacgagcagtaaaccagaatactggatcaccaacaccggctaaaggtcccatcatacctacttttacaccctgaatagctgcgtcatctacttgagcaccgttagctttctcttcctctaaggcaagagttacaccaagtactggagaagctacatatggatgtgtgttgaagaactcaaggtgtctctttaaagctgccttctgatcttctttgtttgtgtacagtttcttaatcgccggaatcatggcgaaacaccatccaccgttctgcatacgttcatagttccatgaaccctgaaggaaagtagagcggagtgcaacagatcgacgatcttgttttgataaagtaattttttcttctgccatttctataccctccttacttcttaataatcatttaaaatgtcatcgagtggatcaccaacgtttccaccgccaccgtttccgtttccacctttttcagataagttgatgtagatgaaagcgattgcaagagcgattgcaccaagagcgatcagtgtaaggtctgaaatagctgccagacagaaaccaattgcgaagaatggccaaacttcttttgttgcgatcatgttgataaccattgcataaccaacagctactaccataccaccaccgatggacataccatctgttaaccatgcaggcatagactgtaagaagttctgtactgtttcagtagggattgcaagaagacatgctgcagggattgcaatacgaagtccctgtaagcagatggcaatgatgtgccacatttctacacctctgaaattaaccttctcagcttcagcatccatacggtgaacacatgctacagaaagagtacgaacaaccattgttaagaataaacctgctacagcaagagggatagctacagcaatcgctgtacttacaccttttactccctgtccaccaagaacaaggataatagcagatgcaacagatgctaaagcagcatccggtgctacagcagctccgatattagcccatccaagagcgatcatctgaagactaccaccaagaacaatacctgcctcgagattgcctgttaccagaccaatcaatgtacatgctaccaaaggctgatggaactggaattcatcaacaacaccttcgataccagcgagaaaggcaactataacaactaaaatcattgaaataattgacatgacttttcctcctaatattaattgctaaatactattttgctaattcagcttttgcttttttaagaatctcatccatgttatcctgagaatcacttggaactttacgaacgtcaaacttaacgcctaacttcttaagttcttcgaatgtctcgatatctttttcatctaaagataatactttgctgactgctaccttgccaacagagtgagccatagaaccaatgttaagttccttaatatctactccacctttgattgctgcaagagcatcctgaggtgtttcaaataataataatgcctttgtgtttccaaaacgggtatcttttgatacctgaatcatcttgctgattggaactacgttcgcttttacccctggaggcgctgcttcacgaatcatgctcttacgaaggtcatcgtgtgctacaccgtcagatacaacgataattctgtttggtcctgtagtctttgtccatgctgttgctacctgtccatggagcagacgggagtcgatacgtgcaagcacatatttaatctttccatctcctactacggttccttctggtaatgctccccttggctgtccatcggaagtagctgctacctttttctcttcctttggctctaagctttctgggtaaatcttaacgccttcttttgcacttccggaaatctgaacagcaagttcatgtgctgtatccatcatcatacgggaagcgtaagcgtcaatgagcattggcaggttaagaccagcaacaattgcccatgtatcctcgtgaccagcgatcaggccattagcctgattaaatggagtacctccccataaatcaacgagaattaacacctgttccgggtcttcgaaagatgcaactgcttcttccattttctttctcacatcatccggtccttcgttaggctgcagtgttacggctgccacgtttggctgttcaccaaaaatcatggaagctgactgctggataccggtcgcaaaattgccatgtgttgcgagaataattcctaccatgttaacttcacatcctttcctctcctgttagaaattattagttactctatctcaatatttgaaacagcttttgtctaaaaacctcatctggaagattcttttccatctgaagttttttgatactttcctctacttccggatctgccatcgtccgataaaatgtattaaaaagcatcggtttttctttgagcatctctgaggatactgcgaataaaaatgcacagcttactttagaatcatcccacaaaatcggatgattcattcttccaatgacaagtcttgtattctgaaccattgccggatttccatgtggcagggcaatgtggtttaaacttgtggaagacatctcctctctttcgagaacagactgcaaatatttttctgttacaaaatcttcttctaaaagtggctgtaccatcgcttttactgcggattccatattcttttcttcaattggaagaataattgcttctaatatatttaattccaataaatggtttacctgaatttctttaattccttccttaatcttttgcatctcacgctccggaagggccattgaaatgtagataatcggaaaatcagctttgagaatgcgctcggttgtcacaatgtagtcgcaatctggattcttaagctgcttaaattcctgcagggaatacattcccgtgacttccacaccaacaagctttctctcgattttagagcggataattctggccgctgccgcaccgaaatgacagacaataataattttcgtcttctcacccgcatccttcattcgctctatcgccgcctgaaaatgaatggctaaataaataagatcattctctttcatagacagattatagatatctgctatgtaatctgccgcaatggccgccatctcgaatccaaaaggatactgacgtttcatggactttaacatatattcatctgtctcaacatccaaatgatttccacgaagaatcgtcgtataaatatgagaagataacccctcaatcaaatcttcgtcctcgctgaaatctgcactgagtctctcgctgattcctttaagaatctccttaatcggatgccgcatcttatccataatctgatcctgacaggcgattttttgtttacgtagcgataacagtaatgtatacatatatcgcagttcttctttagaatccggcagacgaaattcctgacaccatccaagtatccattcatacaatccgtcaaattcctgcgtattaataaaatcttcctgtaccgcaaccggcttttctgtattctcactgtctgcatgacgcgtgagaaacaaaatataaaggaaaagctgctgcaaggattcatcagtaagctgaaaccattccagcctctgcaatgcctgaattgctcctcttgtcctcaacatctgttcctttgtaaaataatgaaacagtggaaaatggagactatcaaactgctccaaagctacgatgtaatcctctccgaataaatatggaaaaagtatctttacaaatacctctcttctcttattctgggatgctgcatagcggataccataatgccgctgtgcctgaatatcttccggatactttttcatgattgccgctaaatgcttctctgcgtaagacttgcttactaaaagctcatctgcaatttcctgtatggtaaggaaattatcatgtagtaccagaagtaagaggaatcttctctcaaattccatctcaaagcgagggatgctcacactcatcacttccgcaaacttctcatgcccctttacaagtatttgattactcgaaacaaactggacatccactccgaattctttcagtgtctcggacaactcctttaactgattcttcaaagtctttacagatactcccagatactctgacatagccttaagttcgacaacttcataatctcttaagtactctatcatcttcatatctcgtcttgtgaatctcatgtttacgaaccactcctcactcaccaaaaattctatcaaattcttcaaaaatgtaaaactcatagtttgacttatttttgaacaaaagatgtgcttaacttaagattttatttcattttacttgcgatttcaatatgtgaaagggtatttttttgaaaaaaatgtcaactttgtactgttattttctatctactggaattttatctatttttttcttgtcgtctcttaaatgctaatacgattgcaatagaaagtgctgttcctgccatcacacaaagaaaatataatgacatatagttcgtagctttaaataaagccacaactaagcccccatgtggcacagccgaagtcacgccgcacacagcagccgccgctccagtaagtgcagaacctgcaacaactgccggaagaacgtgtccggggtcagaagctgcaaaaggtatcgcccctcgctgattcctatgattcccataaatatagtatatattcctgcactcttttcctcaggtgtgaacttatcttttccaacaactgctgcgattcccatagagagcggagccactgcaatggaagtagatacaatccccataatctgaagatttccctgtgcaattgaagtcacaccaaagaaaaaggcgaccttattaatcggacctcccatatctatgccaaccatcgcaccaagcacaataccaagcacaactgcactggaaggattcttcgcaagttccacaagcaaactgtttaacagatccgttatcagtgtaactggctttccaagcacaaatataaacaaagcggatactactgcgacaccggtcagcggaataataaatattggcatcatcggcttaaactccttagcaagattccagctgttcatccatttcacaagataaccaacaagatagccgacaataatacaaccgataaatcccgttcctccctccgttccaagaatctctccatctgttgccaccatcgccccgatcatcgccggagcaagggttgcccttcctgcaatggaaaaagcaataaagcctgacaaaattggatacatcagcgtaaaggcaagattaccgatagcatgaatcttattccataaaccaatatagacaaccgttccatctgcagaagtctgtgcccccattgataccgacagcgatactaacatccctcccacaacaacaaatggtatcatataggaggctccattcataagctgtcctataatatcaatatctgaaagatctttgggctctttctcctgttttttttctttttttgtttttactatcttattcttattatttttatcactttgttttgctttattgttcccagctattgactgttcattttccaattcttgcctatagccttttccgactatcttttcagttttctgattttcttgcgtattttcaactattctacttctatttatcgcattttggtacgttatattttgttttaccgcatctccatttttttctctgttttcaatatttttatcttctgtattttcagcatttttatcttttgcatttttattttgaaaattctctatatttccagagttttcatttctgttttgattattctcattttgaaaagaagcccctcccataatgaaactatcttgttctaaccgctcaaaaacaccctgtgtattctttaataacggtttgattcttgtttttaaaacccacttgccataaaatctctctggctcctcaattactacatccgcggctatgattacataatccgcttttgcaatctcccgtttggtcagcttattttccgtcccctgcgagccttgtgtttctactttcacctcatagcccagtctctcacattccttttctatgcgggctgctgccatataggtatgtgcgattccggtagggcacttggtaactccaattattttcatatctttcctctataattgctctttgaacattattcttaaaatattccaaaatcattccaattcattctttacatactgataaactgcctctgtgctcctgcaattacgaaaatcggcaataaacttctcatccacaagttttctggcaagcctggacaaaaacaccagatatttttcctgtcccttctcttctggtgcgataatcgcaaatgcaatatctacttttttgtcatcaaatgactcccactctataggatatcgaaatcggacaataaataactgtacttcatcaatttcttttataattgcatgaggaatggcaatcccctcaccacatcctgtcgaatcccactcttctctcttccagaatgctttctctaactgtgtcgcatctaacatagtctgttttgcgcaaagtctgcttatcgttcttattgcttccttttttgtaccagaaactgctacgatattgtcaaatattttttccttttttactagcatatccaattactgctctcccttatttccagtcttattttccagagtatatttgaaaatgcaaaaagtaatccacctatctcaattgcaaaaaaattttcaaacacactctgattttcattttttaccatcagtcgcaatacttattgataacacagctctcttctatattctattttccctattctactgtctttattgtaccaaaagaaaaacaacggtaaaacactttctttttccgtttttattcctttctatacgtctttcaaccgtcattttttgtttctttttcaggacaattagccattttgcttataataattgttctcctgtcgatgcaataagaattcatttattcacaatgccaagaaaagacgtaaaaaaacggttattcttgtcaaactcatgcatagacaatccggggtaaaattggtatactagagtcaagatgagtgatacgatttcatctcgtctcaactattcaattaaattatccaatagagcagtcactcctcctccttcaatgtggctgctcgcaagaacaccgtttccaatcagccatcagaacggtgtttttttgcgtctgtgttgccacttctgtatattatatctttttggcatgtctttggatttttcttcatatgattgtaaaaagatttaagatagggattttataatgagggattacattgaattacgtgctattgaggtcgggaaatacattattgactcgaaggctacggtgaggaagacggctacaaagtttggagttagtaaatcgacggtacataaggatttaacggagaggctgccgcagattgaccatcatctggcggatgaggttcgtgatattttagatattaataagtcggagagacatatccggggtggtatggctacgagacagaagtatttgcttcttcatcgggtaaactaaaaaaaatggcttgtctgaattgttataaaatatctctgaaataaaaatcaagaaaaaaactcctgtttgtttcagaaacatcgaaaaagatgaataggaaacaaacagaagtttttattttccctggttttccatttgttgttgtagtcgttcaagctgttctcctactatgtcaaaatgccgctgcattgcgaagcttcctgctacaaagtctttggccactaaggaatcgtaaatattccagtgggcacgtcttaacgcatctgcctgcctttggtttgccataatacgaacacgaaaatctgcgataaactgatttattaattctgcgatcatcgatgtgtataacacaatcatgcggttatgggaagcttctatgagcttgttatgaaattgcatatcaagcttaccgctttcttttggattctcaatttcatccatcttgattaaaatctgatgcatttcttcgatttcttcttctgtcgcatttttaatcgcaagacgtaatgctactgtctcatatcccatacgaatatcatatacttctgtatatttgatttgctgaagcgacataaccatgttcatgaactttaccatatagtcctgtggctcacagcggagatagtttccacttccctgcctacattcaagaagtccgttaatctctaacatgtgcattacttcacggatggaattacgacttacatctaatttctctgcgatttctctttctggcagaatcttgtcatttatttttaattcaccggataaaatctgctcagaaaaatagtcgaatacatactgatatgtcttttgatttttcattttgtaagttttaaaatctgtgaattcattcattttctcgccacctccctgtcatatttttatcattctgtatatctaaatgtctattttataagattcttgctctttttgcaagtgaaaaactttaacacgacacgataaaaaaatggcgggcccactgctcatttgcaggcccgcctacaaaatgtgaaaaatgaatttcacattaagcaaacatattttggctcgagatttatttgaatcttttcaaataaactttattattccggtttttttaccataacggaaacgccatccggaataattgaaatatgggcatcttttcccttttcttttatggccatttccaaagcttcgtttacatcatttgcaacggcaaagcccatctcctgtgccattttgcgatgctcttcgcacatgacatagataactttatgctgcattaagatacgacactgtatctgatattcccactggtctggttttgtctggtcctgtggaacttttaagatttctgccatgaggtctgccggactggagcagtttttcagcgcttcatagaagccttctcctccatgtccgtccccacaattggaaaccataataagaataccatcatcttttgctgccgcttctgctgcagtcattccttttacggactgatacatattctggtcaagtggatatccgccgttggtagaaatagcgatgtctgcggcttttttaggaactacctggcaataatcctgcaagaacttacatcctgcggcatgggcttcaattgcatcgcccgcaacggcgtgtaccactttcttgtctgcatcaataatgacgttaacaatatatttctgatgcgccattttactggcagcgatcatatctttatgaatcggatttccctctaagattcctgttctgctgtatggagaatcaatgaacttggagcagtgatttccgagtaccgttactttgctagatactcctggaaggatgctctttcttcctcctgagaagcctgcaaagaaatgggtttctataaatccttcgcttacgagaaggtctgcatttgcagcgattttgttaattaaaagaggagctcctgatggaagtgtaccgatgtttgccattgcatccatgtcctgactgtcatgaatcgcaatacactcattatctacgatttcctcgccaaacttaccaactaactcttctcttgttgttgctctgtggaatcccgttgcaatcaaaagggtgatctttgcatctggattgccttctcttatttctttcagcataaatggaataatatgcttacttggaacaggtcttgtgtggtcagaacaaataattactacattttcttttccttttgcaagctctgaaagctttggagaaccaattggatgcgccattgcctcgagaacgatttcgtcttctgtcttatcgctctttggcatggactcgatggacgaggataaaacctcgtagtccatcgaatcatctatgtgcagcatcatacctgtggttgaaaaaggtaatttcatatccatgctgctcaactccttaactatttaacacccatccatccagagataaccatcatctgtacttcagaagttccttcatagatttctgtaatcttagcgtcacgcatcattctctcgattggataatcttttgtatatccatatccaccatataactgtaagcagcgtgttgttacatccatagcgtttctagctgctactaatttagccatagctgctttgtgtgagaatggttcgtgatcatcttttgcacatgctgcctgataaacaagaagcttagctgcttctgtctgtgcacgcatctgagccatttcaaactgtgtattctggaactgagaaattcttcttccaaactgttttctctcagtgatatattttgttgtttcttctaatgcaccttctgcaataccaagtgcctgtgctgcgataccaacacgaccgccatctaatgtcatcattgcatatttgaaacctttgccaagttcaccaacaaggttttctttaggaacgatacagtcttcaaaaataagttcgcatgtagaggatgcgcggatacctaatttatcttcatgttttccgatagagaatcctttgtatcctttttctacgataaatgcggagataccttttgttccctgagatttatctgtcatagcaagtacgaagaatacatctgctacacctgcgtttgtgataaagatcttagatccatttaatacccagtggtcaccagcatctactgcaactgtctgctgtccggatgcatctgtaccagcgttaggttctgttaatgcgaaagcaccaatccattcaccagaacataacttaggaagatatttctgtttctgttcttcggaaccaaactgataaataggtgttgcacataaggaagtatgtgcagaaaggataacacctgtagatgcacagtatttacttaattcttctactgtctggatatatgctaatgtatccattccagctccgccgtactcttctgggaaaggaattcccatcagtcccatttctgccatcattttgacatttttcattgggaattcttctgttctgtcgatttcagcagctaaaggttttacttcgtttactgcaaaatcatgcaccatttctaatatatcctgatgttcctcgtcctgtctaaaattcataactatttcctcctgtcacggtcgttattatttcgttgctttgaatttaaaataatgaatttaaaataatgaatttaaaatgttgaatttaaaataaaaccacaacaatatataatattgttcacttgttttacctgtcatcgatttttcaagcattttccgctctgaaaaatcgactgcaattactttttctttgttatcatgttacgtttttgttgatatttttttaacaaatttacctgtgactcaattcacaacaatcttacctgacggctatttcattttatatcgtactggaaatctctgcaggattgatatattgcttttatgtgtttagatctgaccctccggcttgagagggccagataattacaaacttggtaatactatttttatactttgtctttctttattctatactttgcgtttctctcaaccattttctaaagattggttcattatgctcttaaacttaatttatatttttaagctttctctgctttaaatgcttctgttaatgctggaactacttcatttaagtttccaacgattccgtagtctgctacatcaaagattggagcatctggatctttattaattgctacgattgtatcggaaccagagatacctgctacgtgctggatagcaccggaaataccgattgcaaaatataacttcggagcaactgtcttacctgactgtcctacctgatgtgcatgcggcatccagcctgcatctactactgcacggctgcatccaacagttgcgccaagtacgtcggcaagatcctgtaataactggaagttttcctgagaaccaactccacgtccaccggaaacaataatctctgcttcttcaaggttgatagattcagcaacttcttttactctctctatgagggttgtacgaatttcatctgcagctaccgtaatctcttcttttacgatctcacctgtttttgcttcatcgtaagcaccttttttaaatactgccggacgaacagtacccatctgaggtcggttttctggacacatgattgttgccatcaggtttccaccaaatgtaggacgtgtccatgcaacatttcctgtctcttcatcaattgcgattgctgtacagtctgccgtaagacctgtttttaatctacaagaaactctaggtcctaaatcacgaccattgtttgtagcaccaatcatcaatgtttctggtttatatttttctactaatgcaacaagtgcttttgcaaaagcatctgttgtatagtattcatattctggtccatcaacgataattgcggaatctgcaccatagcagatggcatcttttgcaacaccctcaatgtctttaccaataacaactgcgatcaattcacagcctttttcctgtgcaagtggttttgctgcgttgattaattcaaaaccaacattttttggcttaccacattctgtttcaataaaaacccaaatatttttataatctgcaagattcattattcagtcctccttacaaaatttttgcgtcgtaaattaatttaacaacctcttttgctgcatcttctgcttccataccttcaagttttacaccattcttttctgttactggtgtatatgttttctttacttttgttggagaaccacttaaaccgcaacgctccaggctgattgcaggaatatcttcttctgtaagaacaggaatctcttttttctttgcagccattttactcttgatggttggatatctaggttcgtaaggaagtctgactactgtaactactgctggaagctgtgtagaaatcatatcgtaaccttcgtcacattcacgttttacctgaatatctccgtctttttcaatgatgtctaatgcgtatgtaatctgtggaagtccaagatgttctgcgatttccggtccaacctgtgcggtatcaccatcaactgcctgtttaccacagagaattaaatcaaattttaatccttctttttcctctactgccttgattgcttcagagaggatatagcttgttgctaatgtatccgatccgccgaactttctgctggaaataagatatcctgcgtcagctcctacagaaagacaggttttaattgcttctttagcctgttctggtcccatggaaataacaactactttgccgcctaatttttcttttaagcggacacctacttcctgtgcataggtatcaaaaggatttacaatacttggaactccctttcttaccagtgtatgtgtaactggatctaccttaatctcattagtatcaggtacttgtttgatacaaacacaaatattcattcttcttcctccttaatattacagacggtagcaaactttgcctggatttaaaatcatcttagggtcaaatactctcttgatgccttccataatcgccatgtttgtttctccaacagaatcaacaagatattttactttacctgagccgattccatgttcaccggaaacaagaccgccgcaatttgttgcttctttataaataatgtcaaagaatttatctactctcttcttgaactcttcttcttccagatcattggaacactggtaaatatgaaggtttccatctccggcatgtccgaaggatttgataacaagaccacattcttctccggtcttatttacaaatgtaaggtattctgcaatcttattaacaggtacaactacgtcacactcgtcaagaagctttgtttcttccatgatagcctctaagaaagaagaacgtgctgcccatgcatctttcatcttagcagatgtatcagctactaatacatcaattgctcctgcttctaatacaagctctgcagcctgctcgatcaatgcgtctacttcatcttcactgttaccatctaatgtgacaagaagatatgcaccaatctgaactccttctaattcctgtgggaatacggactttccaatgtaacgctcggaagcaagtacgatttctctttccatgaactcgattgcctgtgggttcatgtgagccatcttaaatttaggtacagttgcaagtgctgtctctaagtcttcgtaaggaataattaaagatgcaacagcctttggtgctgggataatctttaatgttaattctgtgatgataccgagtgttccttcagaaccaatcataaggtttaataaggaatatcctgaagatgttttggaaacagttgctccaagatgtgtaatctcaccagttggtaatacaacagtcattgctcttacgtaatcacgtgttgctccatatttaacagctctcataccacctgcgtttgttgctacgttaccaccaacacatgcgaacttttcacctggatctggtggatataacattcctttggactggcaatcctctgctaaatcatttaacaaaacacctgcttcaatctcaacaacgaagttttccatatcgtaggatttaatcttgttcattttagagatatcaattaaaacgccgccatataatggaactgctccacctgcaagaccagtaccagctcctctaggtgttacaggaatattattctcataacaaatcttcattactgctgcaacttcctctgtagaacgtggctgtactgctaaatctggcatatgcgtaccataaatcggcatctcgtctttcgcatagtccggattaatctcttctcctaagaagacattattggaaacttttttaatttcttcgataatttccggtgtcaactgattgtacatatttctacctcctaatcatttccttctttatatttgaaataataaagttcttaaattaaatcatttttacttttcagcccatatcaatatctttaaaccatctggtttcatctgattcatccatgttcattttacaaatgttcatcaaaatgccactacatatgaactatctttcacaaatttatctgttagaatcctgccatagaacctgcatagcagataattccggcaatgactacatatattacaaaatacttaaatacttttcttaaaatctcactctcagaaccaacggctccgatagcacctgctccaatcgcgataccctgtggacaaatcatctttccgatgccggctcccataacatttgccgctgccatccaggaaggattcagtccaagagaaatcgctgtctgactctgtaatccaccaaataatacacaggtagatgttcctgaaccggtaacaaatgctcctaacgctccaactaatggagaaatgagcgggtaaaacggtcctgctacaacaactaatgctgctgcgatatcagaaatcattccgctgtaacccataatcttagctgttgccataacacaacagatagtaagaattgtcttccagtatttctttaacgtttctatgagaacctttcccattgttccaaaggacgctccctgaatcagtccaccgataatcgctgcgataaaaatcataatgcccggtgtattaatccagctaaaggaaagagatcctgggttgtcgcctgcatatacggtgacagttgtctttatgtctgcaatcagattatggattggcggacataatgttgatgtaaacattaacagtaagaagattaagatgaatggactccaagctttcactccttctgaagcggtaaatccactgctttgttcttctcctgataactgtactctgtactctggttctggattcttatttaagaatcttgctgctgcaaccatgcatatcatggaaataatagaaccgataatgttaggaagttcacatccgattacctgtgctgcaatgaaccacggtacggtaaatgataacgaagcaattaaaaccattggcaatacactctttaacgccttaaatccttttcctacgataaataccatgaagaatggagataagaatgttaagattacctgaatcaatgcaacgcttcctgataactgtaaagcatcaaggtttgttactgatgcaagtgttactgtcggaactccaacggaaccaaatgcagttggtgtggagttaacaactaaacaggcaataaccgaaagaatcggattaataccaatcgctgccaacatcgatgccggaatcgctaccgctgttccgaatccagccattccctccatgaaattaccgaacccccatccgataatcagaagtaatactctctggtcaacggaaacactggcaagcatcttcttaattaattccatcgctccagtttccaatgtcaggttatatgtaaacaaagctgctacaataaccaggcagattggccatagtgcattaagtattccctcaagtcctgcggttgcagtacatatgagacttaacttccagtaacctgctgctaatactgctgtgattgccaatgcaatcagacaagctttatggcctgcaatttttagtacactcagtgcgataatcagccataaaatgggcagtattgctaaaaaaaacttcaaaaacaacgatacagcacctcctctgcataccccttaatgggtcacccaatgtttatatttgtattatatcatttatctaaaataatgcaatagtttttgtttttttcggcattatagtgtattttgacaatatttttttggtataaatttttaaattggactccccaatttgtgcacccttcacaatgggtcacccactttttaaagcaggttgcacaatagattactcttttgttgcgttttttacttgtttcatggtcgattttcggatttttgtttcttttgttctatatttgagaaatgaatgctatttttttgttattttgacacctctaagactccagttttcaggcgaatggatgctccaaaaagcgtctccccactttgcaggttaaacaaagttttgtgaatgtgggtatgattagcagccaatataatagtaaatactttagcattgattttttgagatatcggactatcttcaactttaaattgataatccaatatggatacgatataattttcttaacactataaattatattgccaagtcacctaacacgacattcttgggaggtttgtttatgaattttcgtgcaaaaactgtaaaagaatctattgttgaaactgttcacattatccgtccatcggatcttaacgatgctggtcgcctttttggaggtgttttgatgcaatggattgacgaagttgctgctcttgtggcaaagcgtcattcccagatgaatgttacaactgcttctgttgataatcttcagttcttacatggggcatttcaaagagatgttatcgttattattggaagagttacgcatgtcggacatacttctatggaggtaaaagtagaaacttatgtagagaatacggacggggaaagagcattaattaatcgtgcttttctcaccttgattggtctaggcccagataaccgtcctactacgcttccacgtcttattttagaatcggaagaagaccgaaaagagtgggagcgggcagaaatccgacgatctcttcggagaaaacagagggaggaaggcttccacttctatggagagtaaatatgaatttgccgcaggcaaagagacgcccccgaagagagtctaggccacaaatataggggctagactctcttcgggggctgtgctttggctggggagggaaattctatttattgctggagggatttgaataggctccagaaggatgtggctttctgtggagttgttttttgaaggactgatacttgaattattgttgtagtatgctgaaaacacttcaaaaaaagacatcatccataggacataatgtctgaatctgggcgtggtattgtcataaactttaccacagcacagaaatccgggaattaaatcatcttctccccgtggaatgtctcactattaactggggttcatattccaatcgcattatcggacgtttcttttctcttttaccatctttttgttccatgcggtttttctgattcataagcattgatacggcgtaagctcctttttccccgatacagtggtcgatcgtggtgagggagattcctgaaaaagaggctacaagggtattatcaaatccgcagacggagaaatcttccgggattcggtagccgaggcttgtaattgcatccataattccgattgccacaaagtcattggttccgacaaaggcagtaatattttccagacctgtctctttaacgtcttctttattttctatagcgtgttttgatgaaatatcttcttgctttattttttcaatcttctccactttctttttttctttcaaaatttgtactgcttcactatcttctttctttttatataaaagttcttctcgttttttgaaatattttcttgtaagtccatatccggtgtcataatgcttatttcctgtgatagtttcctggtcttctctttttcctgaaacgacatgaatcatagccggatcaaagccctgtctttcatattcttcctgcattccttccaaacgtctgcgtcttggcacttctatagaggataaaggggtagtcatataaccaatatcccgatgtcctaattctaaaagatgtgcagcaataagccggccggactttttactgtctaattctaataattctatttttaagtctgaattatggtcgttaatgaggactaacggaacctttccatgcaaatgattcagggaagttactgctcttggggcataggtatagatcacaccataaaatcccgtgtctgccgccatattcagataatattcttcccgttctttggagcggtttgtgtatgcagtaagagtacacaatccatgttcctgtgcttcctgtgtgataaattgaattaatgttgtgtaatactgtgttgcaagggacggacacataatcataattgtatcattcgttcctgtcttttttcgtttcgctcttgccttgtactcgtatcccatttctttggcagtacgctttactcgctcaattgtttctggagcaaaatggatatcttttctgccgcttaatatcatcgaaactgccgactgggatacaaaacatgcttttgcgatgtctcttgttgtagttcgttttttttcgttcattctatacttcctctacattatattctctgtaaatttattttactttaagcaaaaacattttccatatcttcatgacatactctccacctgcaggacacctctgaaaaaggataaatcaaaactgtatttctatctttatttctctttgtaccgcatatcgctaatcattttttaaaaattaatcagaatcacaccgctctcccattttccttttgattagtaatcaaaccaactggttttctcctgtttttccatgcatttttactaatcattttcttgattaattgtactatgattttgattagtaatcaacggtttccgcccatattgacggatgattttttgtgagtatactgagaaatatcaaaacaacaacacagtatttacccgtcattttaatcaccccattacataatagacaggtaaaaaaacatacaaaacaatacatatggaggttatttatcatggcaaaaaaaatcaatttaaacgactacttaggtcacagcatggattgcacatgcggaaaagaacataagacaaatcttaaaattgtagatatcgataaagatgccgtaagccgtcttccaaaacacattgaagcgcttggatataagaaacctttcctcgttgctgatgtaaatacatgggcggctgccggagcattggcagctgaaaagttagatgtggctggtatttcctataaaaaatacatttttaatgagaaagaactgattcctgacgaaaaaactctcggttctttaatgatggcattttccagagattgtgacgttattgttgctgttggctccggaacgttaaatgacctttgcaaattctccagtttccagcttgggcttgactacatggtattcgctaccgctccttctatggacggttttgtatcaattggagctgccctcatcacaaattatgtaaaaactacttaccaggctcatgttcctctggcagtcattggagatacggatattctcgctgccgcaccgatggaaatgattacggcaggtcttggagatattcttggaaaatacacctgccttttagactggaaaatggcacacattatcacaggagaatattattgcagccatattgcagatatggtaaaagaggctgtagaaatcgttgtggaagaaagtacacgaattaaagaccgcaaccctgatgctgtaaaggcagttacagaagctctcgtattaagcggtatcgctatgagttttgtcggcaattcccgtccggcttccggaagcgaacatcatctttctcattactgggaaatgaagttccaggcagaaggcaaaaaaccaattttacacggtatcaaagttggtatcggtatgattgctgtcacaaaaatgtatgaaaccttggaaaatgaacagtttgattttgcctctttaaaagaacgctcctttgattatgccgcatgggagaaaaaggtaaaagactgctatcaggatgccgctcccggcattatcgctttagaagaaaaagcacaaaaaaataatctggataaacgaaataaacgacttgctatccttgaagaaaaatggccggaaatcttacgcactataaaagaaagcctgccttcctcagctgaaatggaaaaactgctcgcaagtcttggtgcaccaattaatccggcacagattggcgtatcttcagaactcgtagaagatgcggttatccttgcaaaagaagtacgcgaccgtttcaccttattgcaggttctctgggacacaggattactggatgagtatgcaaaaatgattgcggcttattttggggagaaggctaactgttaagtttattaagagacgaaactaaggaatcaaaaaccatgtcttgtaaatattttcgcgctctgatattatttatatacatacaaaaaataacatgaagggagaatgtacaaaatgagtaaatatgcaattggggtagattatggaacactttctgtaagagcactgcttgtaaacattgaaactggcgaggaggccgctactagtgtttacgaatatccacacggggttatggaggaacatcttcctacaggagaaagacttccttctggctgggctttacaggagccacaggactatgtagagggattaattatcacaatccgtaacgtccttgctgaaaaaaaggtacttccagaagaagtaatcggtatcggcgttgactttacttcctctactgttattccagtaaaagcagaccgcacaccactttgtcaccttgaaaagttcacacataaccctcattcttatgtaaaactgtggaaacatcacggagcagaagaagaggctcttcaaattgaccgtatcgcaaaagaacgtgaagaaaaatggcttcctctttacggtggaaaggtatccagcgaatggatgatccctaagattttagaaactttacatcacgcaccagatgtttataaagaagcagaccgttttatggaagctcttgactggattatctggcagatgactggagaagaaacaagaagtgcctgcggcgctggttacaaagcattttatcgtcatgacagcggatatccaacaaaagatttctttaaagcactcgatcctgctatggaaaatatcgtagaagaaaaactcgatgctccaattaagtctatcggtgaaactgctggatatttaacagattctatggcaagagaactcggtcttttagccggcacccctgttggaacaggtatcattgatgcacactcttctcttcctggctgtggaatcggaacacctggcaccatgatgattatcgttggaacttcttcctgccatatgatgctttctgaaacagaagcaggtatcgccggtgttggcggacttgtaaaagacggtattatgcctggatactttggatacgaagctggacagtgctgtgtaggtgatcattttgcatggtttactgataactgcgtgccagaaagctatgaacaagaagcacgctcccgcggtatctccatccatcagcttctcacagagaaattagctggttacaaagctggacagagtggtttattagcactcgactggttcaacggtgttcgttctccattaatggactttaacttaaacggtctcattatgggtatgaaccttcttacaaaaccagaggaaatttacctttctttaatcgaagcaactgcttacggtacccgcatgattatcgaacagtttgaagatgctggtgttcctgtaaacgcactcgtattaagtggtggaattcctgcaaagaacaagatgctcgttcagatctactctgatgtctgcaacaaagaaatccgtatttctggcacagatcaggcaagtgcactcggtgctgccatccttggtatcgctgctgctccagaacgcattactggatttaaaaatgcaaatgaagccgcagaaaaacttggaaaggttcgcgatgaggtttataaaccaaacccagataatgtagcggtttatgataagctgtatcaggaatataagacattacataaatattttggaactggagaaaatgatgtaatgaagagacttaacaaaatccgcgaagacagattaagtgaatagatccttactgatttgtgagtctgcaaggcagacgaactcctaaagctaaatagagcatatttgtgactttagtcgcggcagtttgaatgttcgcttatgcgctcgcattcaacgcgccgcgactaaaatcacaaatatggcttatgaagttcgctggcttcgtctgtagttcgcttaatgaattaaatagtaattctattagcaatagctttcctgtttgtgtatcttgccttttttcactgtttcctttttattttctttcttctggacaacactcactctcctttttgcctgcttcgcattcatgacaagcatctgcagacggttctcaatatttgcaaagcttacgtccggatcatagtcgagtggaagtatctgtacatctgggtagatttcttttaattttttggtgattcctcgtcctactacatggtttggaaggcatccaaatggctggaggatgaggaagaatttgcagccatgtttggcatgatgcagaatttctcctggaattaatacaccttctccagcatcgaaggtatggtgaatgattgggtcgctgtcttttacgagttcatccattcggcaggctggttcgtagagcggatgttctttggcaatggagtctgtcaatttatgggcaaagtcaaagatggtatctgcggtacggtaccataccttctggtcaatcggtttatttaagtgatattcttttatctgggcatcctgatagaagtaagttttgcgaataacatctgtcattcttgcctcaataatttcaaatccattttcttctaagtatgcttcgatatcgtgatttgctcccggatggaagtttaggaggtactctccgacaattaatacctgctgttttaagtaggtgcggtcatatcgaacttttttcatgattgtgattgcctttttaaagccctttcttgctcctgcaattccgtgtttttcaaggccttcgattacttcatctaaggctttttcaaatgcgacatctgcatctccttttgtcagttcatatggacggatttttcgaagaagttcctctaatacatcgatcattggcagggcaaatgcaattcttgctgcggataaaatgttcattttaaagccaggatgcatatcatgggaatcggcatcatcgttggtcagtattggaacatcggcatatccagcatcatctaaggcttttcttaataaagcgccatagtgtgtcagacggcagtctcccacatattttcccataccgatggcaactttctgtccatcatatttgccacttctaagtgccgctaaagcttcgccgataacaatctgtgccgggaaacaaatgtcattatgtacatactgttttccaagacggatagcttcttctcgtccaatatctaatggaatggccttgattccctgtgtggaaagtgccgcagacatgacacggcagaacgcgtgagaagtatttggcacaagtacaactctttctttacggctttcttttgtaaatttcactggatatggctctgctaatggttttacttcatggactaactttttctctcggcccatttctaccgtttctaagaaagagcggacacggattcccaaaggtccttgaatatcactttcatccacctttaaaatgagcggtgttttaccggaaatttctttcatcatacggacaatctcatcggataaatacgcatcatgaccgcagccgaaacttacaacctgcacatattcaagattctcgctctgcgctgctaaaatcgcagaagataacattctcgcatgataattatttaccacatcaatacgacttcggtgaaggtctgtgcgattcacttctggtaaagaatccgcggtaagtactgggattcccgcctttgtaaacattagcgggaggtcatgatttaccaatgcatcgttctgatatggacgggaggccagtactacggcaaactttcctgctttttgtacatcttcaaggacttttgctcctgcctttttcagttctgtatcaaaactcttttgtgccgcatctcctgcttttatggctgctaaagtttcttcttttgtaattccaaaagtttcactcatatacgcaacaagctgtttctggcggtcttttttcgtataccagtgaaacaatggtgcgtcatatggcacaccccatttttcagatggattatctgagtttcttatgacgattggatatccttttacaactgcacacatagactggctggtttcttccgtattttccgttggaactgttgttacggatggcatgaagattcggtctactttatgctttacaagatttcttatatgaccatgtaccagctttgcagggaaacatacggtgtccgatgttactgcagaaagtccatcctcatacatttttcttgtacttttatctgaaatgcgtactgtatatcccaatgcctgccaaaaggttttccagaatggcatggtatcccagtaggataatactcttggcaaaccgatgacttctgttctctgctttgtgctttcttttccatgttctttgatgttttccccgacatgttctgtagaatgttcatttttatatgtattcgaaagattatgtggataatctttaaataacagctcttctcttatcttataaaggtttggcactgcatttaccttttgcagtttttcttttacctgccggtttacttctttatcctttggattaccgataacctctccacgctcacaacgattatttgtcacccaggaatttccgttagaaaacttcacaatcgttctgttacagtggtttccgcagaatggacatggggaattagcatcctgtgtataagaaaaagtatctaagttctgtaaatcccagatttcttctgtttctggacttttctcgtatttttcctttgcaataagagccattccaatcgcacccataattccaggataaggcgctcttactacatctcttcccacatactcttccatcgcacgaagaaccgcatcgttctcaaaggttccaccctgtacaacaatcttcttaccaagagaatccagattggaaacacggataactttcgtaaatacattctcaatgatggaacggcaaagtcccgccataatgtcttcagaagttcttccatttcgctgttcggtgataataccgctgttcataaatacggtacaacggcttccaagtaccgcaggattctttgaagaaaatgcagtctttgcgatttcttttgttgggatatgcaaagaagacgcaaagttctcaaggaaagaaccacagccggaagaacaggcttcatttaaaagaatattggtgataacaccattttccagccagattgccttcatatcctgtccgccaatatccagaataaatgatgcatcctgaatatatttctctgcggctctcgcatgagcaaccgtttctaccgtatgattctttatgtcaaatgctttagaaaagagcatttctccataacctgttgttcctgctgaaagaatttcaagctccgcccctgcctctttataacgctctcttaaatcaatcagtgcctgctttgctacctttaatgggtcaccctcatttggtgcataaaaagaatctaagatttcttcattatcagaaaggagaacaaacttcgttgtcgtacttccggcatcaatgccaagataacctcgcacaacttctcctttttgtggctttttccatgtaatctttttcttttcatgcgctttttcaaaggcagccttctcttccacagaagcaaaaaatggtctggctttctcttcattttctaaagaaatatttataccgtttttcttggcttcttctttttgctgctgaatttgttctaacttcttcaatatgtctgctatggcaacttttttactgcccgcaaacatttcctttaatgataaagcagcacctgccgcaatcattaattcgggatgttctggaattaaaatatcttctttttctaactgtaatctctcagaaaatacacgaaccaagaccggattaaaagtcagcggaccaccttcaaacgcaaccggactctcgatttcaagtccctgtgccagtccaccgattgtctgctttgcaatcgcatgaaatgcagaaagtgccagatcttccttcgctgctccctgattcaaaagcggctgaatatccgtctttgcatatacgccgcaacgaccggaaatgtcatacacatgctcaccctttgccgcaagtgcgttaaattcttctaccggaacttttagtacagatgcaatttcatcgataaatgctcctgtaccaccggcacagcttccgttcattcgcatatcggaaacacttctcatatggtcagtctcgctctctttaaagaaaatcatctttgcatcctgaccaccaagctcaattgcggttccgactttctcatactttttctgaagtgcaatcgcattcgctgctacctcctgtgcaaacggaacacccaaactttccgcaatcggctttgccccggaaccagtcagacacactctgactttctgcgctggcattttttcatcgaactttttcaatatctcaagtacactctttaactgatccgcatgatgtctctcataattagaaaatacgactttataatcactattgcctgtctgcataaccacaatctttgttgtcgtggaacctacatcaataccgaccagaacttcaggctgctctgcctttcttctttcgtctttcataaataaatcctttcgttttataaacatttactatcgcgtgtttaaaaaattctttctgaaagatgtgcgttacaatttgtggaagatttcgcctgaatgaggacggcgtagcgggctacgtcaactgaacgaatgcaaaatataccgcaaattggggcgtgcagattgcaggaatgatttttcaaacacactctaatataaatctaactttttggatattctcaaatgtaatttcagttaaaatcactgtcgtaaaaattgttataaaaataaatagcagatgccacaaaacattgtctgcaacctccactatcagatacaacattgtattatactacgcctttagaaaatatgtaagtctttttttgtaaattctagtttgccgcaggcaatgagacgctcccaaagagagacatttcattcccagagggcgtctattttgcctgcggcaaatcaggatttaaatcaaggttatgattccttctataataaacactgctgcacaggctcctaccgctaccactatcaggctctttctctgataagcaagcacaatagcaaccgccagtcctgcaatagcagagataaggtttcctgtcgcagtaaaaattgccggaattgtcatcgcagctaataccgtatacgggatgtagtagaggaaggagttaaagaatttattttttattttatgttttacaagtacaagtggaatcgctcttattaaataagtgacgattgccattactaacaggtatggtaaaaatattttaaaactcatcttcgctcacctccactgggaataatacagccgcaatgagggatgcgactacggtacagataatgattgcaaaaccaccggagaggtctgcaaataccgggatgtattttaaggctacgctgattgcgacggcaatgcatactgctacaaacacatggctgtcatctcttgcttttggtacgacaacagcgataaacattccgtaaagtgcaacgcctaatgcgtttgtgataatggcaggcaaaatgtttccaagtaaagcaccgcctaatgttccgagtgtccatccaatgattggaataatggtaagtcccataaaatagtttcgtttaattttgcccggattctgtatggctacggcaaagatttcatcggtgatggcaaagccgagaatccagcgccagattcctttgaagtcgtcatcgactttctgcgataatgaaattgccatcagcatatatcttaagttgatgatgaactgggacaaagccatctcaactaatgttccaagttctgctataattgtaagtcctgcaaactgaccggcagaggtcaggtttgtaagtgagattaatactgcctcactgacagttaagtctttgtctactgcgagaatcccgaatgcgaaggaaacggcggcatagccgagtccgatggggattccgtctctgattccctgtttaaagttcatactttcccccaacaacgacagagactgccagctttcgccctgcagtctctgttactacgcatatttttatgcttctacatcgtcaatcgcttttccaatatcatgacgcatatatttattctcgaaagttacccactcagttgctgcgtaagcattctttcttgcttcttttaaatcagaacctttggctgttacaccgagtactcgtccgccgtttgtaacgatgccttcatctgtacgttttgttcctgcgtggaagcagtaatatccgtcatgtttcttgaattcatcaagtccgttaataacatatccttttttgtaggatactggatatccatcagaagcaagaacaacacaaacagctgcgttatcttcaaactgaaggtcgatttcatctaagcggccatcaatgcaggcttccataacatcgatgatgtcatttgtcatacgaggaagaacaacctgtgcttctggatcaccgaaacgagcattgtattcgagtactttcggaccgtcttctgtgagcatcagacctgtaaagaggataccgacaaatggtcttccttctgcagccatcgcatccatcgttggctggtaaatgtatttctcacagaattcttctacttcttttgtgtagaagggacttggagaaaatgttcccattccacccgtgtttaagccctgatcaccgtctttggcgcgtttgtgatcctgtgcgcttgtcatgcacttgatggtctttccatcgcagaaagcgaggactgaaacttcgcgtcctgtcatgaattcttcgataaccatacggtttccggcatcgccgaacttcttatcttccatgatggtctttacaccatctttagcctcttctaatgtattacagattaatacaccctttccaagtgccagaccgtctgcttttaatacaattgggaactttgcagtttcaaggtaagcaagtgctgcttcgtcagaatcaaagttctcatattctgctgttggaatgttgtattttttcattaaatctttagaaaatgctttggaaccttcgatgattgccgcattctttcttggaccaaatacgcgaagtccttctgcctcaaaggcatctacaacaccgcctactaatgggtcatccataccgataattgtgaggtcgatttctttttcttttgcaaatgcaaccagtttgtcaaattccatagctccgatgttcacgcattctgcatattcttcaattcctgcattacccggtgcacagtaaatcttatctgcctttgcacttttagaaactgcccatgcgattgcgtgttctcttccgccgctgcctacgattaatactttcatcggacttcctccattttatgtacaatatactctcaaaattctcaacatatctgttcttaaaacaattgttagttttgaaaattcactacgtctcttccgttatattctattttgaaaatattactatttatcaattgtaacaactctgccgtctacatgtacctttccattcgcaatcagattgattgtttctggtaggatgttccattctgcctgttccatgatgcggcgctgtaatacttccggtgtatctccctgttctaccataacaggcttttgcataatgattggaccggtatcggttccctcatctacaaaatgaacggttgcaccagatacttttacgccgcgtgccaatgctttttcgtgaacatgaagaccataacagccttttccacaaaaggatggaattaaggatgggtggatattaatgatccggttctcatattctttgataacacatggaggtacaacgacaagataaccagcaagaacaacaagatcaatgtctctttcttttaaggcctctaagagtttctggttaaactcttctcttgtctcaaagctctttggagacagaagcagtgcttccgtcccatagttctttgcacgttctaatgcgtaagcaccttcattgttactgattacgacacgaatttctgtattggtaatctttccactgtctaccgcatcaagaattgcctgcagattcgtaccgcctccagatactaaaactgcaacttttagcataatgttactcccttttctcctgcttcaacagagccaacaacgtaagcttcttcaccaacagctttcaatgcctcaattgctttctctgcatcttttggatcaagtgcgagcatcataccgatacccatgttgtatgtattgtacatcatttcttctgcaatattgccttcttttgcaaggagacggaaaatagctggtacttcgtagctgtctttctttacaacagcacgagcaccttctggaagcattctaggaatattttcgtagaatccgccacctgtgatatgactgcatcccttgattgtgattccagcttcttttactgcttttaacgcttttacataaatctttgttggagtgatgagagcttctcctaatgtttttccgagttcttctctgtattcgtttaatgcttctttttccatagggaatactttacgaacaagagagtatccattactgtgaattccagaggaagcaattcccacaaggacatctcctgccttaatatctttacctgtaatcaggtctttttcgtcaacgattcctactgcaaatccagcaagatcgtactcatcttccggataaaatccaggcatttccgctgtctctccgccaatcagagcagcttcggactgcttacatccttctgcaacaccgcttacgatggaagcaatcttttccggaaagtttttgccacatgcaatatagtcaaggaagaataatggttctccgcctgcacacgcaatatcgttcacacacatggcaacacagtcgatacctactgtatcatgtttgtccataaggaaagcaacttttaactttgttccaacaccatctgtaccagaaaccagtgtaggattctccattgtcataaacttctttaaagaaaatgctccagaaaatccaccgaggtttgtaagtacctctggtcgcattgttccctgcacatacttcttcattaattctactgatttgtatccagcttcaatatcaactccggcgttcttatagtccatgacagactcctttcttttatcctgtatatattttttattactaattattataattccccgccaacgaatagctttccttccctttatcgaatactacatctgctttaaatactcttcgtatccaatctcttcaagcttatcggcttttgctactacctgattctttaacttttcagagtaagcttttaatctttctaacagttcgggatcggatgttgcaagcatctttgctgcaaggattccggcattggctgcaccgttaattgccacagttgctactggaatgcctgttggcatctgtacgatggagtacaaagaatctacaccacctaaatcagatgtcttcattggaataccaataactggcattgggaagattgcggcacacattcctggaagatgtgctgcctttccagctccagcgataattactttgtaacctttttcttctgcaccttttgcgtaagcgaaaaattcttctggctctctgtgtgcagagatgattgtcatatcaaagtcgattccaagttccttgagtacatcggcagcttttgccatgattggcatatctgaatcgctgcccattacaatacctactttagccattgttctgctctcctttataatgattttacttattttacaaaagcgttctttaaatcttccttcatatcaaggactgcctggcggctggcatctgcatagtccactggactaaacttttctttataagggtctttctggtaagcacagataattccacggctggagtttacgatagctccaagtccgtcttcattaaagaatggtgctaagtccttaccttttccaccctgtgcaccatatcctggtacaaggatatagttctttggcataatcttacgaagggctgctcccatctctggatatgttgctccaactactgctccaacgtaactgtaatcttcacccatcacttctttgccccattctgctaccttctcggcaacaatctcgtaaagaggctttccatcaatctctctatcctggaattctccgctggatggattggatgtctttacaaggataaatgcacccttattattctctttacatacttttaagaaaggctttactccgtcagaaccgagatatgggtttacggttacaaagtcttctgtaaatggggagtatatatgctcgccaatctttacagttccaacatgaccaatcgcataggcttcagaagtagaaccaatgtctcctctcttgatatctccgatgataacaagacctttgctcttcgcatagtcacaagtctttttgaaggctttcattccctcaacaccaaactgctcatacatagcaacctgtggcttcactgccggaatcaggtcataagttgcatcaataatgcccttattgaactgccagattgcttcgcaggcaccttctaatgtctctccgtatgcagcaaatgcatcctttacaagatgctctggcacataagaaagcattgggtcaagaccaacaacgataggtgcgtctttttctttgattccttttactaactgattaatcataacttcctccagaattgtactgatatctttttcattctagcataaattttttcagatgtacactcacgatatgccaaaaaacgacacgattattgttagccgcgatatacaactttaccatcacagatggtatacttcacttttccgtataactgtgcaccaagaaatggagaattttccgccttcgattcgaaagattctacagtgcggacttcatccggtgcaaaaattacaatgtccgctgcctttccttcttctaaagttccacagtcaaatttataaagtctggccgggttcactgtcattttttcaagaagctgcatcattgtaagataacctctttttacaagactggtaattccaagagaaagggaagtttccaatccgacgatcccacttggtgcttttgtaaattccctttctttttcttcgatggcatgaggagcatgatcagttgcaatcatatcaatcgttccatctgccagtccctcgattatctttgttctatcccactcggtacgaagtggtgggttcatctttgccatcgttccatagttcggcacatcttcttctgttaatgtaaaatgatgtggggttgcctccgcatatactttcgcgcctttcttctttgcaaggcgaactaagtcaaccgaacggccggaagagatgtgctgaatatctactttagctcctgtctcaagggcaagcattacatctctggcaaccatcacatcttcggagattgccggtgctccgccaatacccattttgtcagaaatgactcccttgttcacaccatttacttcattcagtgtagggtcttcttcatgaagtgaaatcggcatatcgactcttgctgccgcttccatcgcttttttgataaaccctgcattggtcagaggaattccatcgtccgtaaatccgcaggtacccgcttctaccattgcatcaaagtctactaattcttttccttcaaaattttttgaaaccgctgaggcctgttttacatggattggaaggctctttgtacgctctaaaatatcctgaaggacttctggtgtgtctacaattggttttgtatttgccatgcaaacaacagtcgtaaatcctccagctgacgctgcacgacttcctgtttctaagtcttctttgtacgtaaagcctgggtcacggaaatggacatgaacatcaacaagccctggtgcaacaacacatccttcagcgtttaattcctcggcttcctctgcccattctggatgttctccaaagccaataattttttcatcttctacccagatatttgtcacttcatctcttcccgaagccgggtccatgacacgaccatttttgattactaacttcattgtatctcctcactttatttttacttatctttgcaaaaatcacactactacttgattgcaacctgcaaagattgtttttttcaataatttaaaattatttttcagcacgacttaataactactctaataactttaattactgtatctgttattttccctcaaaaggctcatttaacttcaacgtaccctctaacacaaatcttccatctaacagaatcggaatctctacgcgttcctctgctacatcattcataattggaacttcaacagtctgagcagtaactgctgcaattcttgaaagttcctcataaggaatcgtaatatccgtatgacaattaaaatacgccttcttcggatcttcttttcgaaagacggaacattcgttttcttttgccacgatttctttgccatccgggttatacacacggacatcctcgcagtaagagtagcatgtatcgccaatagcgatatgcggtcccattttctctgcgataagaattggaagtttctccatgatgccatacttcgcagccattacataggctgttgtattcgttccaatcgcacactctcccatcggaagcgtctctctgttgtataaaagattctccttgataaacttacgtccatcctctttatctgggaagttcgcacactcatagtcatctaccataccatctttaaaggtaatctttaaatctttataacaaagaccatttaaatacacttctgtcacatgtaaaagtccgtttgtccccttcaatttcggagaagtaaatacttcgccaactggaatatttacatcggcaagacagttttcaaactttgtctctttctgtgcatctttcaaatcacaaagagcaacggtaagatttgtcatattccttccacgacccatgatgtgtacggattctgcctggtcaagaatattgataatattttgctggatgcctttatataattcattatccagcgtattgactttacggatttcctcaaaaatttccgggaacttttctccaatagatggaactggataggcaataatcgtaaaacttctttcttcctgattaataaattcatttaacaattcattcgacaaagaagaatattctacagaaaggctctgctgacgctcactcaggcgatagctttccggcttattgaccggctcaaatggttcttctccaaacacttcgaaacatgctggtcctgcaaaacctgccgcttcctgttcatactcctcatatgcctttctcatacagcttatcttacgatcaaccatacgcttatcgagataaatcgcattatcaaagcggtggtcataaccatactgtggatttggatcagaggaaatgtatccaatacggaggttctgtcgcttatttaacgtatttaatgcctctctgtaaataaccggcttcaatcccatagctgcaaactgcctgattgctgcacgaatgactctctcaaatccaattggataacggatatttactgtatcttttttagaaacatcgactccctttaattcaaatcctctctggtacccttctgtaaatgtcgctgcaatctgctcgatttcttcgtctgaaagtccatttaaaaattctgcagttttcagttctacttctgaaatataatctccataagaatacaaataccgcaaatctcctaaatcagaatccataataatagaagttgcgaaatcaagtgccggatcaactaactctcttactctataacctgcccagtcatcggcataatcatagagaaaccagtaaatcgtatctttaatctgcttataacttactgtctcatcttcaaacatacagtaaatctctaaaaacagttcgtttaaaattgtaatcttttcaagattttgctcgaaaacaaacgctctctcagaacgtaattccgtatataaaaaactcagaatccgaccaaactcttctcctaattcctgtactgcaaatgcaggattcgcaaaagactttccgtaattctgaggtaaaatatcctgatagaataattcattttcactcttcatctgctcaaaagaacaggatttccacacatcagaagaaatgcataaaaaatctgacgcacatttttctaaaaactgtgcagtcttcttaaaatagcggtgaacctgttccttcataccgtttttctctccggcagcaatctctccaattctttctcttgttaataaaaaacgttcttctacttctttattgctctctttaaataactctctataatccatataagtcttatcatcctctctttctatacttttgcataattatcatcacatcataataaatgtaattccaataaaaatcgccacaatattaatgcagattcctgatattttgtatttctggctagttttcgcatcatcgtagctcattacgccccagagaacacaaaaaaatgcaagaatcatgaggatacagccaattaatcccccaataacattcagtcctccaccggtcacgacagacaatattgttaaaatcacaaaacctattaaaatgataatccccataaccaatgtaattacagcattctttgaaacctttttctcagaaaaggaaatatttcttgtattcatactctggcctttcctttcacttacttttcatcttttaatcttcttctttctttttattctttgccttccatttgtgataaataaatctgataatgcaatagatgatccagccaatcagaccaccaaccgtattcatcatcaaatcatctacgtcaaacacaccaacctttgtgataagctgtaatgtctctatgcaaaggctgaataaaaaagcatatataataatccggatacatccggttttctccaatctccatatcggaactaaaaaacctattgggaaaaatacaagcagattgccaaataagtttagtaaaaatgctccggcagaaacataattcctgtatataataaaacggcggatttcctcaaaaggaactaagttatagcgatatgtgctatagccatcccctcgtccaagccggtcgctgaataagacaaaatatattacgacacagccatataaaatcaataataaaaggcttagagaccctaacctctttctgttttcattcattcctttcccagcctttttccctcagagcatatttgaaaaatactctggttattctcgtttccattctttttgcttttatatttcctataatacattttaaggaaccggtatgtaaaccggttcccaccatttttaaatcattattttcccttttaatttcagggcacgtgctccactgacaatagaaaccacgccaacgctgactcctacaattactgtgataattccaacaacaattcctgaagcaccaatctgtcccaatgttttaaaaatcttttcgttcatacaaatctcctgtcagaatattactttactccatactggtcatagtatgcatcaatggctgcttttaatttatcatcaatgatgacttttcctttgtatggtttgttgtaaagatgttctacaacttcttccattgtaacgattgccgttgtcttcattccgtacttttcactgatttctgtaagagcactcttctctccctgacctctttccatacggtcaacagaaacaactaatcctccgacttctacatcgccctgcgccttaataatcgggagtgtctcctgaatagaagtacctgctgtagtaacgtcctcgataatgataactttatctccatcctggattgggcttccaaggagaattcccttatcaccgtggtcctttacttccttacggttactgcagtaacggatatccttatcgtacttttctgaaatagcgattgttgcagcaacacttaatgggattcccttgtaggcaggtccaaataatacatcaaaatcaaaaccgaaatggtcatgaattgcctgtgcataatattcgcctaatctctttaactgagagccagtacggtaaaatcctgtgttaacaaaaaatggagtctttcttccactctttgtcacaaagtcaccaaacttcagtacgttgcaatcgatcataaattctataaactcttttttgtattgttccataacaacctccgatttatccttttgatttctatgtattctcgaaattctatttatatcctgtttcaagaatacattcagttgttctgattctaacacagtttatttgtattttcaacacgctggagcgtgtttgaaaaatgctctgggaaaatgtattctgcaaatatgcttatttaataagtatatattttagtcaatacatcctataatctcgttaatatcctcgatatggtatctttccatatatgccttcattccgtctaatacttccattgtcgcacgaggattatggaaattcgctgttccaacagaaaccattgtcgcacctgccatcatcatctcgatggcatcttctccagtgagaataccacccattccgatgatcggaagcttacatgcgtggcttacctgataaaccatacgaacagcaactggcttgattgcaggaccggacataccgcctgtcttattcgcaagcacaaacttacgtctgtgaatatcaatcttcattcccgtaatcgtattgataagagaaagtgcatcacatccaccggcttctgctgcctttgccatctctgtaatatctgtaacgtttgggcttaacttcataacgattggctgttttgcctttgccttgattgcctttgtaatttcatataaagcatctggattctgaccaaaagcgataccaccctcttttacatttgggcaggatacgttaatctctaataaatcaactggttcatctgcgagacgttctacaacttccacataatcggaagtactccttccacatacattgacaataatagatgctcctttttcttttaaatgaggaatatctctcttacagaataaatcgattcccggattctgaagtccgacagcattcagcattccaccataagtttctgccacacgaggggtaggattgccctcccacggtacattcgccacaccttttgttgtgactgcgccaagtgctgcaaggtctacgaactgttcatattctgcaccagaaccaaatgttcctgaggcagttgtcacaggatttttaaatgtctttcccgctaatgttacttctaaattcatgcaaacactacctcctttgcatcaaataccggaccatctttacagattcgggtattgtttacgtttgtgtgatggtcttttccctttgtcttgcagatacagccaagacaggcgccaattccacatgccattctctcttctaaggaaatttgtgcttccattccgtgttcttcggcataaactgcgagagcttttaacattggcattggtccacaggcatagattacctttccttcaacaccatatttttcaatggcatcaataacggttccctttgctccctgacttccgtcttctgttgcaacttttacatcacagacagcctcaaattcgtcttttaagaaagtggaagttctgtaaccaagtacaactgttttttctacattaagctgttttgcaagctctaacattggaggaatcccgataccaccaccgatgataatcgccttttcctcttttaaagcaaatccattaccgagaggtcccataacttctaaggtatctccctctttcatctcggaaaattcttttgttccctctccggcaacacggtaaactactcttaaagttccctcttctttattaataccacaaatactgatcggacgaggcaaaagcttactcttgtcgttacagtacattgcaataaattgtcctggctttgctaatgctgcccccttagggaaggataattccatgtcgaatatcccctcgtcaatctgctgctgacgaacaacttttgcagtttcttttatcatctccatctcttttcctccttctaaaaataatgtactcccgaaaatttccccgcaaaatcgagtgctgaaaacttccaaacaacctacttcttatcttaccataaaatctgccgcactggcatatgaatatctaattttatgaaaagaaaaaatttccgtcaaaaaagcagataaaacaatactctatccgcacactattttatgccgtttcattctttaaaatataaaccggcagcggcggattattgggtttattataaaaagcttccacaagtacagtatatttatcatccgtcaattctcgaagccatgcaagtacctgcttcttctcttcaaagccactgtctcccccgctataaataagcagggaaatcatgcctccctcatgaagcagattcagtcccttttcaagggcctcgattgttgtatctgcctttgtggaaaggctgtgatcccctccaggaagataaccgagattaaacatgataagagaaacactgtctttttgagcatacttatccatatgtgcatgactgtctaaaacaacttctgccctatcagaaagccgttcttttaaaagccgtttttttgtctgctctatcgccatttcctggatatccatagaaattactctgcccttttctcctacaagcttcgccagaaaaacggtatcctttccggttcctgctgttgcatcaatgcaaagaaggggttcctttatcatctgctgtatccgttcatgacaatattgtgtgattggcgttcttctcttcattttaatcttgactctccaatttttattatattactatttaattcaagtaaatttagctactgtcagccctcaggaagatacctgctccatatttgtaatctcggagcaaaggttggatgcaaacgcataagcgaacattcaacctgcagcgactaaaattacaaatatggagtaggtatcttcctgaaggcgtctgtccttaataaattaatctttatttaacgaaaaggaaataagcagcaacaacaatacctaaaacaatacggtatacaccaaatgccttaaagtcattcttcttaatatatcctaacaggaacttgattgctacgatagaaacgatgaaggcaactagcataccaaccacaaggattgtcacttccattcctgtataatggaaaccatattttacaagttttaagaagcttgctccaaacatgaccggaatggataagaagaaagaatattctgctgccacaaaacgggaagttccaagaatcatcgctccaataattgttgctcctgaacgggaagtacctggaataagagcaagtacctgaaaacatccgataatcactgcaatcttatatgttaaatcagataattctcctacttgtggttctctgtgtttattatagttctcaacgataataaataaaataccgtataaaattaaagtaaaggctacggttggtgcattataaaaaagtgcatcaattttatcattaaaagcaagaccaataactgctgctggaagacaccccacgattacctttccccagatatcaacggtctctctcttttcttttgcagacttcttcggactgaatggattcagcttatggaaataaatcacacataccgcaagaatcgcaccaagctgaatgactactaaaaacatttccataaagtctttgggtacattcagcttaatgaattcatccacaagaatcatatgtcctgtagaactgattggaagccattctgtgattccttccacaattccaagcaggattacttttaacatttcaattaacatttatttgttcctcctgtaatatttatcgcttcattctaccataagttaccgtatttgtccccctattgccgtagaagatttttgctattttctaaaaattatataactttatagaaagatagtgcactgctactctaattctaaaagtccctgttccatcagatatttgatagaaaacagcctcggtttcttactgttatcaaatcttatttttatcttatcgtcttttaactcaagaatcgtgccttttccaatatttttatgaaccactcttcttccctttttgaactcctttttatcataacgaagttcgccgatatagcgggatatctgtgcgtccttctgataaagttcctttaaagaatataggaaaagataggttttagctcttgtaacagcaacataaaagagccttctctcttcctctaaatctgcatcttttactgcttttttatgcggagttgtcccctcattaatatccataacaaagacgacctcatattccagtccctttgagctgtgcattgtcgtgagtgtcaccccgcttttttgctgctgccgtcctgcctccatctgcttttctaattcctccccataagagtctatgtaggaaaaccattcttcaaaactatgatattctttcgcactttcctgaatctggttcaatacttcctctaaatcatctggattcatccttcgaaactgtgcatattcgttcatatagtcctcataaccaatcccgttacgaatatattgtatggcagcatatggttccatttttcggagcaggcacaaatccatctccagcttatcaatcttttcatagagccattttttgccgaaggtttcctgctttaactttttcaaatctacctgggggtcagtaagcatacttcttgaaatataacgttttgggcgattcattatttgtaaaaataactttctgtctttgtttcccatcgcaatctttatatacgttaatatatttcttgcaatccagtgatcaaatatatttggaatcacatctcgcatctgaaatgggatattatactccatcaagcggccgacaagaagtcttggctgtgtatttgttctgaaaatgactgccatttcttctagtggaattccctttttatgataaaaacgtattccttttaaaatatcagtgcattcttctccagcatcttttaaatatcggaatgtaatcggtacctttttgccgcgggctgcctgcatatttttcggaaaacgctttgtgttatggctaatgagatgttccgcactgtccacaatctctgcactacaccggtaattcgtatttaaaattacttttttcgcatcgggataatctttttcaaatccaagcatgatttccggcctggccccacggaaacgatagatggactgatcatcatctcctacaataaacagatgatctccttttcctgctaacatccgcacaatctcatattgtactttattaatatcctgaaattcatcaattaatatatactgaaacttttgctgccacatggcgaggatatctttcctctcttttaaaagttcatagcaaaagaccaacatgtcatcaaaatctatgagattctcctctcgaagtcttctctcatacccctcataaatctgagcaaatagctcatcagagcaattactgctgtgatagtaggaaagggacatcatctctccttttacataactgatttcgttaatgatgccggaaaggaattccttctcatcttcgatttccagttccatattctctgttatctctttgatataacgccgctttacatcttcacggataatatttcctgccgtatatcggtatgcatagcgaagaatcataaagaaaattgagtgaaaagtaccaaatgttaccggtgcattctccatcccatcaaaggcaaaaaaacgctttctcatttcttctgccgctgcccttgtaaatgtaataactaatatattcgatggatgtacccccgcattttcaataagccattttacgcgataagtaattacaagtgtctttcctgaacccggaccggcaagaaccattaacggaccttctttatgtgtgatcgcttcttcctgttctttgttaaaaattgctggcacttctcctcctcctttctttctgtatgtactctcggaatctttttatattataaggattctaaaagtaatccgagataactcatctattttttagagtttctcctgctttaaatgtatctctctgcaggagtacattatcattaatgataaaataaatgtttgcaaaataaaagggtgtctctcaacacccttttatctttaatgcagttaagttaaaatactcttctgccattctttgctattaatgttttgcaacgctcttaagatatgcttcaacttcagcttctgttgtcaaagacattgccttagctgcaacagcatctgcttcttcttttgtccagagagagattccctttctggttgctaagatagaagtcgcacttacactaaattcattcattccaaaggaaattaataatggagcaagtaatgggtctgctgctgcttcaccacacataccaaccatgattccctctgctcttccggctttgataacacgttcgatagaacgaagtactgccggattgtaagcggaatagagatatgcaacctctgcattacctctgtctactgccatagtatatcctgtaagatcgtttgttccgatactaaagaagtctgcttcttttgcaaaaacatctgccattaagcttgctgcaggtgtctcgatcataataccaactttgatattctcatcgtatgcaacaccttctgccttcagctcctctttcagttctgcaatcatgttcttcactgcacgaagctcatctaaacatgtaaccataggaaccatgatacggatatctccatatgcgcttgctctaagcaatgcttttaactgaggacgatataaatcttctctctttaagcataaacgaattgcacggaaaccgaggaatggattctcttctttctcaagagcaagataaggaatctctttatctccacccacatccaaagtacggataataactggtttgccctctaaagtctcagctaccttcttatatgctgcaaactgctcttcttctgtaggaatctgaggacgatccatgaaaaggaattctgtacggaataaaccaattccctcgccatcacactctactactttaagggcatcttctggcttaccaatgtttgcacaaagttcaaccttaacaccatctgcagtttttgtctccctgccaacaaactgagcaagggcagctttctcttctaaatatgctactcgtttctgttcatactctgcctgaagtttctcatcaggattaatatatgtctgaccttctgagccatctaaaacgaccttatctccgttggaaatcttttctgtgattcccggtatactgagtacagccggaatttcaagagcccgcgcaagaattgctgagtgggaagtcttaccaccaacctccgtaagaatacctgtaacattcttagggttgattcctgcagtcatagatggagttaagtcttctgctacgagaacagttccctctggtacattcgccagatctacatcttctacatccagaagtatcttcaataatcttgtctttatatcacatacgtctgttgctctctgctggaacatctcatcatcaatagaagaaaacatctgcatataataatcacagattttctctactgctgcttctgcacacatcttatcatctgcaatgcttgtctccatctgcccagtcatctctgggtccataaggagaaggacatgtccttccagaatctctgcttctttctcccctactctttctttcatatcatctgccattgcctgtgtttttgcaatacacttgtcaagggcttctgctaatctcttcttttcagcgtcaacatcactgactgctttattatcgtatgcaagggaaggctcttttacaataacagcggaaccaataccgattcctgctgatgcaccaataccagtatacattatcttcacctcaaattttgatttacaattattctcctaaaccggattcaatcatttcgatagcagtctttaatgcttcttcttcgtcagctccatcacactggatttctacttcagaaccgcatttgatgcaagcaccgataatgttaagaaggctctttccgtttgttgctttaccgttgaagttgattgttacgtcactgtcaaacttagccattcctttagcgaatactcctgccggtctcatgtgaagtccctgtgggttgttgattgtaactttctgtgataccatagttaatttctccttttcttaataggttaatataaattaaataatagctaaagaaaacaggatactgtgctgctggctgatgcattcggttagtattataccctgcattcatacctccccttgttcctttagtactcattattttaccattttttatatacactgtcaatataacagcgcttagagcggtttgaaaaatactctggattacccgtaacttttttcttgtaattccatttaaatccttgtagataaaaagatatattctttctttcctgcctcatcatcaggataaagttctacatattttttagctgcctcatacgccctatcgtactcctgcgccttctcataaataacaatctttccgtacataaaaccggccttcgattcgccgccctgttcgattcctttttgtatatatttgagagcattatcataatctttctgctctacataaatctcgcagattttctctaaaaaatctgtgtcatttgtgctgttccatccctgttcatatactttcacggcagccttcgcatctccagattttgcaagacattcaccctttaatatataatactgtgcatttttgctatcattatttatgagtttatcatatattttctctgcttcatcatattcttttaattgataatgactctctgctaaatagcaggtcatatccaaatcaagcttacctgcaaatacagactgaagttttaacgcctgtccaagataagaaatcgttttcgaataatcttcctctttaaaataaagcaatgcctctttacggtattctactttctgctgatagttatgccactgaaaaacaccaattccggcaagtaagattacagcagcgattacaacacgaattataattttacgcatagaaaacctcatttctctttcaacgaaagaaaggatgccgcagcatcctttccaaagaactattattttcttaaacctaactgttcgattaaggttctgtaacgttcgatatctttaccttttaagtatgcaagaagatttcttctctgaccaaccatctttaaaagaccacgtcttgaatgatgatccttaggatttgctttgaagtggttctgaaggtcgttgattcttgctgtaagaagtgctacctgtacctcaggtgaacctgtatctccttctgttcttgcatattttgtcataatttcctgtttcatttcctttgtaatcatgttacaattcctcctattattataatcacctttacgaagataaggtcggagactccataccctggcaaaggttctagcaaaaagcatctttcatagattagcatactcttgtttttttgtaaagtttttttacgaatatttttcaagaagtttttgaaaatattccggaagcggtgcttcaaactctacatactcacctgttcttggatgaataaagccaagtactctggcgtgaaggcactgtccggtaagccccatcgcattcttcggcccataggttgtatcccccaaaagaggatgccttatacttgccatatgcacgcggatttgatgggttcttcccgtttccaactgacattctatgtgattaaactgatggttcagatgactgagcactttgtaatgtgtcactgcacgcttaccattcttcggttccaccgccatcttctttctatctgccggacttcttccaatcggtgcatccactgttccctcttcctgtgtaaaattattgtagacaatcgcctcatactttcttgtaatggaatgttcttttagctgctctgccagacttttatgcgccatatcattcttacatacaacaagaacccctgtcgtatctttatcaatacgatggacaattcccggacgaagtaccccgttaattccggaaagattatcccggcaatgatataacagcccattaactaatgttcccgtatatcgtcccggacacggatggacaaccatatcttttggcttattgattaaaataacatcctcatcctcataaatgatatctaaatccatcttttctggaagaacttctaattcctttaacggaggcacacagataacaacattgtcctccactttaagacggcagcctggcttttcttttttatcgccaacagttacccggccttcttttataagtttctgaatataagaacgcgaatgctcttttaactctccggctaaaaactgatcaaggcgcattccctcctgttcttccataacggtataataatatttttgttctatattttgtttttgattctgctgcatcatttcatttctttctgccattttcccgtcctgccctattcctgctctttctttttagaaaatactctgttaagatcttcttcctgatagaaaaacagtatcagcacaactagcataaatgcggcaaccgttacataaatatctgccacattaaatactggaaagttaatcaggctaaaataaataaagtctactacatatttccgaaacactctgtctatcatgttaccaaccgctcctgcccccacaaaatacaggcaggctttcagtggtataaaatgtttttcttccggaatcttccctgaaatccacaggagaccgacaagtactgctaatgtgataatcaaaaagaaccactgtttattctgcataatgccaaaagccgctcccctgttctccacatagtatatttctaatacattatgaataatcttaatacttcctatcggttttaatatttttaccgcccacaactttgtaagctggtcaatcagtagtaatacaaaaaaaatgactactgactttgctttttttcccatgataattttattcctcctgttattctagagcgtgcaggttgctggaatgatttttcaaacacgctctaaaaccgtaagcatctcttctggtgttacatcctgataaattgtagcttcacccaccttgtctaaaaggataaacttaatctttccatgttccattttcttgtcatgtcttgtttcttttacaatatcttctgctttaagttcttctggtaataccggaaaatcaaaatatgcatataattcttttatttctttattttcttcctcactaatataacctctttggcaggatatatccgctgccagtaaggaacctactgcgacacactctccatgtgcaagagaaaaattcattaacttttcgatagaatgacccaatgtatgaccaaagttaagcaatgcacgcacaccatgttccttcgggtcttcctcaacaactgcccgcttaatctcacagctgccctcgatcatataagctagtgcctcatcttccctttttgctactgcctctttattgtctttcatccattcaaaatatgctttatcgcgaatcaatccatgcttgatcacttctcccaagccgctgtggtactgtcgctcagaaagtgtttttaccgtgtttacattaatatataccagctttggcatataaaatgcaccaaccatatttttataggcatgataatctacaccagttttccctccaatactgctgtctacctgtgctaaaagactggtcggaatctgcacgaaatcaattcctctaagatacgttgccgctgcaaatcctgtgagatctccagtaacacctcctccaagtgcaagaagcatatcttttctgtcaaattcatgcgtaataagaaaatgatacagactatccactgtagataagttcttactttcctctccttcctgaaaaatgtacacttctaacttcgcacactctttctctaaaagactgcacacttcctcaagataataagatgcaacctgcctttctgttacgatgcaaagtttccgttcttttattccaaaaacagaaagttcttttactaattgattaaaattattctcaattacaatatcatatacctttttaccctctgcagttacttctaatctttttgtttccattgttccctccagaataaatatttacacagagaggggatatatgaacggcctccactccgtccatatatcccctctgtcttttctcgttcaactattcttttatcatcttttatgtattcgctttatgtatctgacatctatgtcagcttaaaacttcgtaagttccggggacaacatatcctcgcttacaatctcgtctcttaaatctccagatacttcaatattacctggtgccacaataaagatattattagaaatcgctttaagagagccatctactgcgaaacttgctccaccgataaaatcaatgattctctgtgcctgtccgatttcgattccctctaagttcaccacaattgtcttgccttcctttaagaaatctgctacaatctgtgcttcattaaatgtctgaggtctgattactttcacactttcaccttcttcttcttttccatgaaatgggattactctgctctgaccgtcctcatcgtcttcctgtaattctgtaagatctttcttcttacgtcttaaggaaagaatcggtttatgaggttcttcttccttatcttccatctcttcttcgtcataaccttcttcttcggttacttcgttatattcctcatcaaatggttccgtctcgtcatcagcatcatttaacttcatcatgtttaagaacttttctgcgaacttcaccccatgtacctcctgttatttattataattccgcgccccaaagattccggtaccaactcgtaccattgttgcaccttcttcaatggctacttcataatcattggtcatacccatagacaaaatgtccatagatacattatcaatgtttttctctctaatgtcaacaaataatttgtgtaatttcttaaaataacagcgattttcttctggatttgccacaaaaggagcacttgtcatcagtcctctgatgtggacatgtggaaatttgctgatttcttctacaagactcatcacctctggaccgtcgataccaaacttcgtatcttcctgcgcgatatttacctgtacaagtatctgtgcgtccacacctttttttaccgcttctttctcaatctgttttgccaaatgaagggaatctacagaatgaatcaattctactttatcaataatatatttcactttatttgtctgtaaatgtccaatcatatgccaatgtaccggttttgaaatattctcatatttatcacacagttcctgtacataattttctccatattcaagctgtcctgtctctaaaagttcctcaatatcagagagaggtttcatcttacttaccgcaacaagcgtaacttcctccggttttcttcctacacgttcacatgctttttttatgttgttttgtacattttttaaattttccttcagcatcagtaaatcacctggccttccttcactgtatcactatttaaaataattctatcataaagttctattttactgccggaagtagaaacaatgcaataatctccattcctttcaaccatatccaccagagcaaaaaccgcataacccttatttaccatatatacccccagaatctctaccttatcgctgtcttttatggtatatatcttttgtttatccgtctcagatataataattgcggtcttcaaatctttcgatacaacataggcatatttatcatttgttttatagacaatggctgaagtctgtcttaatactttttctccctttttgtttgtttccataatattaagctggtctttttcagcagaattgcctccgtgcacaagaaaacttttcgggattctgtaaacactctttttcacaagagaactggacggaattttcaatccattcgtttctgataatgtaagtgatacagacagataccgctgatttaaatagcgctgtatataattatcaaatgacagtatcacataatactttccattctgtttcaggcagcggtaggatgttgttgtcgtaaaattatctttttgaaacgtaacctgtatggatgaattatcctctgctctttttttgaggcggttataaccattttgtccaaccggcaccatcagctgccagtcctgcccttttataaaacgatataccggagaaccggctttttgcttcttattcgttctaagatcactcatcttcgccttactaagaaatgtttcttctgacacctggctctgctttaaattctcctgcccatcagacacaaaggaaaccagtccctcctgtgcagaggttacttcaacgtaagaatctttcccatatttttcttccagttctgctttatgctctgtcaacatcgcatccgtataatctaacaatgtattgtttatgtcattctgcgtttcataggatagggaaaaatgattatccgtatatccctcactaaaaatttttaacttttctatgatctgttctttttcatcaagactcattgtattctttttttcgagtactttttttaaataatcctgaatctcaccggtagtatctatcatatatactacaccgtttttatttaccatcgcaccatcctggacatagtaattaatatatccatcctgcgctgtattgaccagattttcctggcgaagaattactccggtcccttctatgttatccacaatatcgcttgcactcacctcataaatagcaagcttatcttttccaatataggtaagcatatatgccatcagatatactacaataacaagaaacaccagtgttccaagattgatgtgtatatgtagctttcccttttcttttccggccatattacatctcccatctatttagcgccgcgccatttagataatcacagcgtatcccctgaacatactgccgttcttccataagtgctttccactcatctgtaagcttccaccaactgtttccccaatttgaaaaggcagaatctttttccggtattcggctaaatagtctctctacaacaatatcttttcttaaaagagagataaattctgccaggcgttctatatactcctgttttgaacatatctgtatattgcccgcttcatattctttatataatgcacattcctttggaatatataaagaatgtaactttaccatagaaactggcagtgcagataatactcttgcagactctctggcatcctccatcgtatctcctggaagattcaagatcatatgcacacaaactggaaaatgatatggcgcaatcaataatacagcattaataaattccgccagaccatgtcctctgttcatagccgataatgtatgataattcactgtctgaagtcctaattctatcgaaacttcaatacccgtccgctcacggaaattctgaaatgcttccaaataatcctgtcttatgcaatccggccttgttgaaagagaaatttcaacgatattctccattccagcggcctcttccatatattgaagcaaggcaggcagcggcaaaaacgtatttgtataattttgaaaatacacaataaacttatgagcatgataccttttctctactttttccctggaggactgtaactgctctaacacaggcatcgtactttcttttgcttcaaatcctgttcctgcatctgcacaaaagagacatccgcctccctcttttctattcggacaggtaaccggaagatttaccggaagcttatataccttttctccatatttttcttttaaatactttgaatatgcgtaataatattgtttttccattttagcttaaaccataaaaaggcagcctcatagtattatgaggcgccttaaaccttttcgtatcttattcaaattccagatatccgccatgtatgtatattaccggacggttctgtatcagataacatcggattataatgcgtgagaaacgtatttctgtacagattccggcatattttctttatctacggaagcgctgattacaaaacttactccaaacttctcggataaagcatccagtttttcaactgcatagtcaaggttgtctttgatacaagctgttgtaaggaaactgtcaagataaatcttatctaagtcatgatcctgagagataattcctgcgataaatccgaggaacatatctgtatctgtaacattaaattcaggaactacgataagacgaatctgattgctaagctcatacatatgcttattgttcttatcaaggtaaacgatcgtgccttttgtcagcttaatgtcatcatttacctgctgaattaaaattttagtttttccttttcctttcgctcctgcaataatatcaatcatgtgaatatcctcctttagatatgttattggaccgtagtcctttcttttgtaatatgaaaggctcgtgccactttcttatatgctatattataatttatatcatataaaagcacaacctttaatttgcagttttctctaacaactgtgacatagatgagtacagcatatcttttgtttctgctccaagtactacagaaaagaaacgctctccctttttattctttgtcattaggatcaggcaggacttagccatggaagtagttcctgtctttccaccatacataacaacgccctccggcactgggaattcattcaacagatagtagtttgtactctgcatatactcattaatttgtgttttcttcggcgtagtgtatgtcattgtataatctttagaagataccgtatcaacaaaagtatcatactttacagcttctttaaatatcagataaagatcatacgccgttgtataatgattattatcatgaagtccattcggatttacgaaatgggtatgcgtcgctcctaattctttggcctttgcattcatcatgtcaataaatttagattcggagccagccacatactctgcaagtatcactgcacagtcattcgctgatttgataagcattgtatgaaaaacctgccctaccgtaacagtgtctcccttcgtaagtgtactgataaccgctccattctccgtcagattaatatcatgttttaacgtaatttcatcatccatatttccatgttctaatgttaataaagctgtcatgacctttgtaatactcgctggatacaatctatcaaaacaatgataagattctaatacttcattggtgctgtcattgatgagcagatccgcataatcattactctgataatttggatcggtcgcttctgaatcagataacactgccagatccgatgccatgcctttaagatctgaccccacctcttctttattttttgcataataagaggcaaaagaatctgtaatcttaaaaggcgctgtactgcatccactacataatgctgctgccaaaaccaaaatgcttattgtgcatattaatttctttttcatagtcactcttttctttttgtcctatctgtacatctcacgccactcaagatctcctctttcaagtgccttaactaataattcggcagttgcaagattcgttgcaagtggaatattgtgtacatcacataaatgcataacattgaagatatctggctcatgaacctgctggttctgtggatcacgcagaaagataaccatgtctataaggttatgttcaatctgtgaagccatctgctgttctccgccaagcgggcctgccagatatttgtgtattgtaaggttggtcacttcctcaatcagtcttccggtcgttgctgtagcaaacaactcatgcttattgagaattcctcgatacgcaatacaaaagttctgcatcagtttcttttttccatcatgtgcgattaatccaatattcatatatttcccctcctagtaatgtctttgtaatcctatatttagtacaatccctatacctgccatataacttaaaagtgatgttaatccatagcttacgaatggtaacggcaatcctgtattcggaagaaattccgttgccactccaatgtttataaatgattgaaagcctataagcgccgccattcccgaggcaatgagccgcccgctcatattctttgccacatatgccgtctttaaacattctatcactattatagccaataatgcaataacaataacacttccaacaaaaccggtttcctctcctactaccgagaaaataaagtccgtctgctgttccgatacaaaaccggtatctgctacagtaacatcggctatggtattattatttaatccctttccgtacagctttcctgaaccgattgccataacagaattatcctgctgatacgctgatgtggatgagtattttgacggttctaagaaagtcataattcgggtaacctgataatcatgcagtaagatctgattcggtgtctgaatataccatatgaataaaaatccaagtggtatcattactggtataatgatcttcaaccatttcttaattaaagccattgaaaatccacctacaaaaatgacagacagtaaaataaatgtaatgtctaatgttgtagacaagttcggttctattactaccagaaaaagaggcagggcacataaaagagcaagtttaagcagtactttccactccatgagatcttcctcatgctcctgtatgtataccgccacaaatataatcataataatcttagtcagctctgatggctgcagtctggtaaatccaagattaatccatctttgtgcaccatttacactaacaccgacaagctttacgagaacaaggagtacaatattaatcatatataaaactctgttgaaaccacatacaaaattaaaatttacaacagacaaaaacaacattactcctgtacaaaatataagtccaactagctgcttgctcgtgtagctgctgtccgcactattgataaacaatactcccattccactcaagatgagaaccgcgcctatcaatacccaattataatttttaaattggtatttctgctttaacatgtttgtcctcctgtattcgctaccttggagaccgcaactccttaatcggaatattagcataaattgccggaacatttccgtgtccgccatccgattccatctgcgttatctgaatatctaatccgtctgtatcaatctccatgtacttcgaaatcacttttattatgtcgttttttattaattccatcgtttccggcgagcagtttgcacgatccgacactaaaacgagtttcaacctgtccttcgccgtatttcccgatgttttttttctaagaaagccatccatgaaccccattagattctccccctttaatagccacgcttaaataagtttgctatttttttcagaatgctttctgtctcgaattccataattggcacttcttctccaagcactctatgacaaatattagcaaacgcttttccagcctgtgtatcagaaccaacaagaggttctccttcatttgttgcaataacaatactctcatcatctgggacaaccccaattaaatcaatagccagaatatcaacaacatcttctacagacatcatgtctccacgcttgaccatatccatgcggattctattgataactaattcaatctttttcagctcttctgcctctaaaagtccgataatcctgtctgcatcacgaattgctgaaacttccggagtcgttacaatgattgctctgtctgcacctgcaatcgcattcttaaagccctgctcaattcctgccggacagtcaagaagaatataatcaaagtcttttcttaattcatctactaactttctcatctgctctggacttactgcacttttatctcttgtctgcgccgatggaagcaagaaaagattagaatatctcttatctttgattaatgcctgttttaaacgacagtttccttccacaacgtctacaagattatatacaatgcgattctcaagtcccataaccacatcgaggttacgaagtccgatatctgtatcaatcataacaactttctttccaagttttgcaagccccgttccaatattggccgttgtagtggtcttcccaactccaccttttccagatgtaataacaattacctcactcatctctgttctcctttatattcattaactaatactgatttcgctaatcaacgacctcgtaatcgtctcaatgaaaatactgtcattctccacgaatgcaagctttgccagcagttcctgacgattcttctttttggcattcttctttgtatttttcaccctctgatccggcgagcgcgcaatataactgccaatctgaatctgcattggttccatcataagtgccgctacaaaagcactattatcctctggatagcctgcatgtaccgttcctttaaggcagcctaatacaacaacattgccacctgcaacaatctgcgcccccggattaatatccccaagaattactatacttccatctacttctatcttctgtccggaacgtaatgttccacggtaaaactgtccattctttgcaatgcggttttccggaaaagactctgcttcctgacgtttcttttccttcttttcttcttctcttatctcattaagtacctttgcgaactgcgtctcatatacttttgcaccatcaatcacacaactgatattcagtccgctgttttcagatattgtatcaaccaaaagattctgttctcctgacgtgagctcacgtcctgtaaaactgactgcaatcggtttatttaaatcgaaaaaatgagtagattccttaaacttgttcccgacttcccgaagaagttcttcaaaaggaagtgtcggattcaatacaatctgaaatccatatttattccctttaataatgacggaacttttcatatctcctcctgttttctaacatgtgctcccggaatctttctgtacttgaatttgtgagagtacatcattaatcattacttccatctgaacctgtaggcagtaatgctgttgttgcttttttctctgccttgctggcctttccaaaatagtacttatagatatctctggcaatctctgccgcatttgctgaagtataaccatttggcactactacagtcatggtaatatctggattgtcatatggagcataagatataaataatgcatggttcggacgctttttattttcctgtgccgtaccagttttacctgctaccttcataccctgtttctcatacagatatttgatagaactgtccttaccatttaccactccaatcataccctttttgatcagatcaaatgtggaagactttatgtctaacttctcttctgttctcttcttatatgatgtaattacactgcccgaagaatctgttgtcttctctataagagagaggtctattaaattcttatgatttacaagagaagttacatatcttgaaatctgacttggtgtataactgtgtgtaccctgtccaattgcagaacgaatcgcatcttcatcagaaatatgtggttcgtattctgtaatctctactccggatttacgattaaaaccgtacatagatgcatatttctttaactttgtcagacctctctggctattatacgttccattcactgtaccaagattatatcccatctgatagaagaagaagttacaagatactgcgattgccccacttacattaagagatccatgtgcattcggataaatccagcatttagctgccggtgaaatcttatcaaaaatccctgtacacttcacatatgtagaggcattcgctaccccctcttctaaaactgctgtggaagaaattggcttaaatgtagatccaggtgctgtccttgactgcgttgccctgtttagcattggagaagataaatccgtattaagcgatgcataataggaagagtcaattccattcgcaaggcggttattattataacttggataagaaaccattgcctttacctcccctgtatctggatctgtgataacaacggaaccagaacatggatcaagtgcgagctgagccggcgtaatctctatattctttatcttcttatacataaagttataggcagacattttacctgtatacaaactattatagtccttatctttctttttatcaagaactccctgatcatacaaaagcaggcagaccttcttgccgcttaaattgccgtttttaatcatatactcatatagaattttatcaaagtcttcctcagatttcaatgcatcaacaatataatttatcaattcatcataaatttcatctgcatcataataatcggactttatgttaaaagaactgatattaatccactcattattaatcgcatgtcttaaaaatttacggaacgtaatcttctcatctttccagtcaaggtatacctgatcattctcgtcaattgaagaagcaacaagaataccatcgttctcaagcatcttgtaaatatagcttacatagtcttgtttttcttcacttaagttcttacggattgtcgtgccgctctgcaaatcttttcgaagagtactaagaaccgtttcctgctttttcctgtaaatctgatagacatctttttcattcgttttggcctttttccttgaaagcttggaaatattaataatattattatcaataagtgcataatacacatcttttattggaactctcttttcagaacctgctgtgtctgctgttgtcagatgtgcaagcagaattcctgcaagacgtctctctaaaatattatatgcatatttttgtaaatctgcatcaatcgtcagataaacattatttccggcagatgcctttgttgtctttactgtcttaataaccttaccaagattatctaccaaaacatctttctggcctttcttaccctggagagtactttccattgttttttcaattccggtttttcctacaacatcgtttgcttcatacttgccgccattgccattcagttcttttaattcactttctgaaacaacacctgtatatcctaaaacagaagaaaaatatttggcatcattatatttacgaagagagtctgccttaattgaaactcccggatattcatcatcatgttctgaaattgccgcgatacttttatcgctgatattcgttgctacggtaatcggcgttgtctgagaataacgattcataaatacatcatatcttacagacataatctttaatgtatcctctgtagaataactatctgcgattccaaacatattacctgttccctgcggtccgttctttccacttcttaaatattcatatacctcttctggtgtagaattcaaatacttctccgctttctttttctcgtctcctgaaagattatcaatattggtaataccataaatatcttttttaaatctggccagcgaagaacctgataccgtaaacttcagttttcccttactgtttactgtcataggaagactgtagtttatcgtatctccattcgtttcaagcaccttgatcagcttgtagattacttcgttcttaacatcattctctgttactttctgaccattcttcccattcgcattcgttctctcacgagcaattcggcttgtctcgtccgtattttccaatgtcaccgtataagccagctggttataggctaacgtttttccattacagtcataaatattacctcttgcaccactgatttctatcgtcttttttattttgtaattaaagtttgctaaatgttcgtcaccctgtataatctgcaaaacaaaaagacgataaataaggaggcagaataacaccatcagcagtactcccatgattataatacgatttgaaagcagctctataatctgtcctcttaattttgttttatctttttcctgctttttcttgaacttaaacaaaatctgcacccctcttttcgttcttttccagccaatcatttatccttaataaaatctggtagcatacaagccctaccgctacggtatataccatttccgggagaataatattcttaaggtagtaaataatccgcaaatgattctgtaaaagtccgcagagaatatacataataaatccataaatcaaatcattcactccgattaaaacgagaggaagaatattatcatcagaataataaatccgattaaaaaatccatctacgaaaccgaataccatatataaaaaggcaaatccaccgattgtcgaaccgtaaaaaatatccatcagcagaccactgaagaagccaacaatcattcctggtttctgtccgcgcattaccgctactgaggaaataagaataagtaaaatatttggcgtgattcctgctaacttaatcaactcaaacacagatgtctgtaatataaaacaaataaataccagcactgctgtcacaattcctcgtttcataataaatcccttcttacacaaatggcggaaagagaaatatctgtacgatactcttatttccgcctgatttatcctttaatctgcactgtcgctgtctgcgggaacttcttttaactgtgtgatgaccaacacatcctcgatatgctgaaaatccacaaatggagttaccttagcagactttgtaagattggaggagtctgtggaaatcttgcttactgttccgattttgattccctctaagtacttagaactgatatgtgacgtaatcagctcctctccctctttcatatctgcatctttactaatataggtcacatcaattgtgccatctttttgcacagactcgctgtttccctgtacaacacaggtgtctcctgcctgtgaagactttgcactgacactactgctatcattaatgatagaacatactttagcataggtacggccagtctctgtcacaattcctaccagcccgccatccgctataacgttcatattcaccttaattccatctttggaacctttattaataacaaatgtgttataccagttgccgcttcctttactgatgactcttgcgccaaccttcttgtactgagaataggccttgtctatcttcaagagcttctgcagattatttaattctttttcgttggtacttaaagtttcgttttcctgtgttaactctctgactttttcattaagctttgcattctctttttttagttctttcatactcttaaaagagccagcatgatcgcctacccatacaccaaaagagttaattccgtcctgcattgggattactactgtttctgcaaccgcagagagaggtttcactgcatcttttaatactgcactgactgacagaagcaatatgcagatgattgtcagaaagacaagcatcgttttgggtgaaaactcaaaattatgacgatttttcatagtaccactccctgattagtgaaaatcagaatcctgtaaattatgagccagtctttcataatccggattttccatgatcattccaagtccttttactacagtaagttctggctcttccatcttcataatagaaagacctgtctcctgctgaataagaagatcaagattcttgatatgtgtagaaccaccagtcatacatacaccatcatgcatgatatccatagataattctggcggagttttctctaaaataaacttgattgcatcaatgatagaagaaaggctttctgacattgcctcaaaaatcagatgatttgtaacagttaccttattaggaagtcccgtaataagattacgtcccattacatcataggtaatctcctcatcctctttgataccgctggcaagctgcattttcagtctctctgcactcttcataccaatcacaagattatgctttttctttacagtctgctggattgcctcatcaaactttgttccaccaatttttaagagacggctctgcacgattcctccaagactgatcagactgatttctgttgtatctgctccaatattaacaataagacggccggttgcatccattacgtcaagtcctgcaccaagtgcatctgcaattggcttctccacaatacgaatcttctttgtctttaaagaagaacttgcgatcaggtcatagaatgcacgtttctctacttctgtaatatcagatggtactgcgatataaaactctgcgttaccgccggcagcaagaccttctgcaaactttttgccatgcattcctttaaaataaagctggatcatcgtctgcatcgctgtaaaatcagcaataacaccgttgatgattggctgttttacttcaatgttcttcggtgctttctcatacatagaatatgcttcatcacctaatgctaatggttcttttttcttcaccatagcaatcatgttcttctgatgtaaaattactcctgcggctttctggtaaattttgatggaattcgttcccatatcaattccatatattttttcagacattggtatgtctcctttcgttagcatttatacatgaaacaaatgcggcattaccgcatttgtttctactctttgtcagcgtacttttaaaatcctttatacctgattttaaaagtacatttatcctcacatcatctgctgttctcttaagctggtataacacttatcccctataatgatatgatcagaaagcggaatccccaggagttctcccgcctcttttatctgttttgtaatcacaagatcttctctgcttggttctggacatcccgacggatgattatgaatcaaaatcatgtaaactgcctcgtaccgaagcgcctccacaaaaatggtccgaaccggaacccaggaactgttcgctgttcctttcgacagtaaaatctctttcatcagcctgtgccgtccatccaaaagaagaagcattaccttttcaacacaaagatgccgcatctcttccatataataggacgcaatatactctggcgagctaaaatcactctcttctttaatagaagctcttgccagacgtttcgacaactccagtgcacacaaaatctcaattgccttgacattccctattcccggaatcgtctttaacatctccatatccagatgatacaagcctgccaatcctttataaacaggatgtctgtccaaaagtgcaaatgcaagttctaatgccgagtagttcttcgttccacaacggataagtacggcaagtaattctccgtctgtaaggctctctgctcctgccttcaaacacttctcatatggacgttctgtttccgggcgctgcttcatcgttactgactgtctttccatattggtccctcctgaattctctccagacacggacacgctgattgaaaatattttaccataaaaacaaacttttgtatatagggttcaagggtaggtttcgttaactttctgtgtcatttattaagatatttttaagttttcctgtctcatatattttttgcagagacatcataattccatatttggcatgttcccatgtaagtccgccctggaaataaacggcatatggttctttcatcggaccatctgcactaagttcaatcgaggaaccggaaacaaatgctcccgcagccataattacctgtgcatcatatcctggcatatcccacggttctggacgaacaaaactgtctaccggtgcggccgcctgaattccctcacagaaagctaccataagttctggatcatggaattctacttcctgaataatatcatgacggctctccttgctgtcaggaattactttaaatcctaacttttcataaatatttgccgcaaaaaccgcaccctttaacgcgccctttacaactgttggtgctaagaaaagtccctgtgtaagtgaagttgtaacgccaagcgttgctcccacctctttgccaagtccaggagaagtcagacggtaagctgccctgtcgatacattcctttgttccacaaagataaccgccgatcggagcaagtccgccacctggattcttaatcagagaaccgacaatcaagtctgctcctacctgtgatggttcctcaatctcaacgaactctccataacagttatctaccatacagagtacatctggttttctttccttaataaaatgaatcaactctccaattctttttacagaaagagtcgggcgggaggcatagcctttggaacgctgaatagtaacaagctttgttttttcatttaatgccttctcaataccatcccagtcaaactcaccatctggcagcaaatctacctgatggtaactgatgccatattctgcaagagagccattggacggacgaatccctataacttcttccaacgtatcatatggcttgcctacaggggataacagttcatctcctggtctaagctggctcattaatgcaagcgcaagcgcatgtgttccacaggtaatctgtggtcttaccaatgcatcttctgttccaaatacatcagcataaatcttttctaatgtctctcttccaatatcattatatccatagccagttgtcggtgcaaagcaagcctcacttaaatgatttttctgcatcgcacggagcaccttcatctgattacattctgcagttttatctatagataaaaagcggtcttttaattcttcctctactttcatgcaaaagtcgtagaccggctttgcgattcccatctgtgcataatactcttccagtatcttatctctttgttccattacagattcctttctcttttattatatttaaaacagaatcaagcaggttcttttcctgttcatattcctttttattcagccagacaacttctttttcccgtcgaaaccaggtaagctgtctttttgcaaaacgtcttgtatctcttttgactttatcgacagtctcctctaaagacatctccccatcaaaataatcaaaaaactctttatagccaagtccctgcatggatacaagatcctttgtgtatccttcttctatcaatccttttacttcctcaagaagcccgtcctccatcatcagatcgacacgtctgttgatgcggtcatacagcacttctctatcgtgatataatacaaaatacgcaaaattataaggggagtctttctgcctttgttccttattatgctccgataacttatgtccggtctctttatggtattcgagtgcccggattactctttttacattattaaaatgtacaatctgtgcatattccgggtcaacttccttaagaatttcgtaaagatattcttttcctttttctttcgcaagctgttctaattcctttcggtaactctcctttccttcatgctctgaaaagtcaatatcataaagcaacgcctgaatgtaaaatccagttcccccgacaataatcgggatatgacctgcagcataaatcttctccatcgcagctttcgctctttctacaaaaacaacgacgttgaattcttctgatggatcaaattcatctaccagataatgcggcactccgtccatttcttccggacgaatctttgctgtaccgatatccatctttttatacacctgcatggaatctgcactgataatctctccgccaatactttttgccagaccaatagaaagctttgtctttccggcggctgtcggtccggttaatataataagaggttttttctgttccacaaccatccccctctactgtactcgcttaaactttttttctaattcatactttgtcatagaaataatcgttggacggccatgtggacactgatatggattatcgagcttcataagctgatccatcagtgcatccatttcctgataagacatggctgtattaccctttacggctgccttgcaagccatcgttgccaatctgtctgtgatcatttctaaattcatcttaccactgttttcctctatctggtcaaaaatttcgataaacagctcctgcgggtcaattccgagcagattcgccggaaccccacgaatacaatactcgtttccgccgaattcttcaataagaaatccaagttttttgaaagattcttcacaaatcttaaacttctgctgttcttttatgctaaaagtaagaatgaccggaggggcaaccatctgctggacaattgtattattttccaaatctttctttaacttctcatacattaccttttcatgtgccgcatgctgatctacaaaaaacagcttctcatcaaattctaccagccagtaggtgcggaacacctgcccgatgatacggtgctttggacgggcttcttcggaaaggagcggaacatcggcgaagctcatttgggtgccttttccgtaagtatctgcttctttcaggagttctttctgtccacttggctttttatcctgttttatttgtctgtcatcactttccgaatattcttcagcttttgcagtactttcatccattgattttggaatcacatcatcaatctcttttttgattgcgttgttctctccgacatgcagtcgggcaattctttcttctatcgaacttcttcgatttgaaatttctgttgcattttctgaattttcaccgtgtacacctgaataaccattaacacttccagacatatttcccgtagtgttttgggcaggattttgaataggattttgtgcattattcccgtcattgccctggacagaatctcgcacattattttccatactattttttgctaaaacagataccctttgctctgcagcatctccctgctcttttctcttctcaatctctcgaatcttttcttgagagagagaggaaaaacgctcttcaatcgcccgtctctttctttcgaatggctctggaatcttctttacgctttctttttctttcttatcattaccgattcctacttttggaatcagttctttttttacaaagctgcttcggactgcactcatcacagaggaatatagttcttccgcatttcgaaaacgcatctccatctttgccgggtgaacattggcatcaaaacaatgcgggtccatcgaaatcattaaagctgtaaacgggaacttatgcaccattgcatgtcctttataaccttcctcaatcgccttgctgatgatattatttttcagataacggccgtttacaaaataattctcataatttcgatttcctcgggaaataaccggctttccgatataaccgtctaccagaattccgttttcatttccctttacaggaagaagattcatcgccacatctcttccgaaaatgttgtagatcacatcttttagatttccgttaccggaagtagatattttatttttattatcacagataaacttaaaagaaatatctggatggctcaaggcaagacgctggataaaggattctacataacctgcctcggtcatttttgattttaagaactttcttcttgccggtgtgttaaagaaaagattacggatgataaaagtggttccttcaggacatccaatttcatcatagctcttttcttctccaccctctatcacatagcgaataccagaaattccttcatctgttttcgttaccagttctactttggcaaccgatgcgatgctcgataaagcttcgcctcgaaaaccaagagacacaacggtctctaaatcactcgcagagcggatcttgctggtcgcatgcggaagaaaagcctttcgaacctgttctttctcaatgccgcagccgttatctgtaattcgtataaaatcaataccgccgcctttgatttctacggtaactgctgtagagttggcatctacagcattttccacaagctcttttacaatagaggacggtcgttcaacaacttctccggcagcaatctgattaatcgtactctggtcaagaactcttatctctggcataatttctcccttctgacatttctatcttttctctattattccatcactttttatttttatgatctcaatgcattcattattatagatatatcactatgtttgtattagggaataaacatactatgtaacagtcaatttacttacacttcttctgcaactcgtaaagctgattcattgcttccatcggtgtcatattactgatatctaacttcttcaatgtttcttctacttcacttttctttggctgttccgcaaccattcccatcgtatcaaacagggaaatctgtactggttctacctcttctgtatgtttctttccaatattttttgtattcgctgtaatatcagactcttctagttctgctgcgatttcttttgctctttctataacaacttctggaacgcctgcaagcttggcaacctgaataccataactcttatcagcacttcccttaataatcttacgcaggaaaataatcgtatcacctttttcctgtacggcaatgcagtaattattaacacctggaagcttaccttctaattcagtaagttcatgatagtgagtcgcaaatagtgttttcgcaccagatagtgaagaaccagctatgtactctacaactgcccacgcaatagaaagtccatcaaaagtacttgttcctcgtccgatttcatcaagaatcaggagactgtcctttgtcgcatgacgcaaaatattggcaacctcactcatttccaccataaaggtactctgcccagacgctaagtcatcagaggcacctactcttgtgaaaatacggtccacgagaccaatgttagcagactttgccggaacaaaagaaccaatctgtgccatcagtacgataagcgcagtctgtctcatataggtagactttcctgccatattcggtccggtaataatatccacacgattctttttatggtcaagcagcgtatcattggccacaaaaagttccccagacatcattttttctacaactggatggcggccatctttaatgtcgataactcctctctgattcagtgttggtcttacatactggtttgtctctgcgacaagcgcaagagaagcaaacacgtctgtccatgcaatcacacttgctgtcttctggattcgctccatctcagcagcaagtttttcacggattgccacataggtctcatattctaaagcgtacaacctatcttccgctccaagaatcgttcttgcaagttcggacagttcttctgttgtataacgttctgcattggcaagtgtctgacggcgaatatagtactctggcactaaatctttataagaattggttacctctatataatagccaaacactttattataacgcacacggagatttttaattcctgtcttttcacgctctcgttcttctaactcggcaagccaggtttttccatcggtctttgccttcttcaaatgatcaatttcctcatcaaatccttctttgatgatgccgccttccttgattgggattggtgggtcttcctcaattgatgcctccagtaactcatgaagatcttctaatgtatccaaatccccggccattttagcaagaacccctttactgaactgtgcaagaatatccttgatatatggcagatactgaatcgatgtcttaaaagaaatcaagtctcttgggttcgcactgcgataacttactttcattgtaagacgctctagatcatagatagaattcatgtactcacgaagttcttcacgcgccataagattatcttttaacatttccaccgcatccagtctgtcctgaatcgctgttttatgaatcagtggctgttcgatcatcttacggagcattctcgctcccatcgctgtttttgtcttatcaagcacccacaaaagacttcctttttttcctttttctctcaacgtctcacaaagctctaagtttcttctcgtagaactatcgatcaccatataattttctgtggaatacacttttaattccattaaatgtgaaagagaattcttctgagtttcatgaagatactgtaataacgcaccacttgcaatcacaccaaacggataatccgtaagaccgattccttctaaattcgcaagattatactgttctttaattaacatttcacaattatctttttcaaaataataacttgcaaccggagaaataactgcgccgaccttatccttgataaagtcaaagtccatgccgcagatacaaaatgcatcattgcagataatctctgatggctggaacttattcatctcatcaaaaagtgcgtcctgatgttcaacctgcgttgttcgaaattcaccggtagacaaatcacacacaccgattccgaacaggtcatcttcacagaacacactcataatgaaattattttttgactcatcaaggctctgggtcataacattggttcccggtgtaactacacggataacatccctctttacaattcctttggcagcctttggatcctccacctgctcacagatggcaacacgaaatcctttctctactaacttattaatatatggttcacaggaatggaaaggcaccccgcacataggcgccttttcttcctggccacaatttttcccagtaagagtgatctctaactctcttgacgcggtaagcgcatcctcataaaacatttcatagaaatctcccagacggtaaaacaaaatacaatctttatatttattctttatctggaaatactgttccatcattggagttagtttagccattgacgctcaacctccccagataatagaatcctttggattcctctaatacaacaggaacaatctttccaattaaagaagcatctcccttaaaatgtacgacgctgttattagataatcttccggtaaccattgtatcatctttctcatcaatttcttctactaacaccagttctgtattaccagtaagcttaccattttgctcttttgccgcctcatttactacttttaataagcggtcaaatctttcatgtaccacatcgtctggcacctggtctggcatttttgccgccggagttccagaacgtttagaataaataaaggtaaatgcactatcgtattttgcctttctcacgacatcaagtgtctcctgaaaatcttcctctgtttctcccggaaaacctacgataatatctgttgtaatcgcaatatcaggcacagcggtacgaatcttatctaccagctcaagataatgctcttttgtatattttctattcattaacttcaaaatacgactgcttcctgactgtactggcaaatgaagatgcttacaaatcttcttggaatgtgccattacctcaataagctcatcagacaaatcctttggatgagaagtcataaaacgaattctctcgattccctctacctcttctaccattgtaagaagctttgcaaaactgattggattctccaagttcttaccataggagtttacattctgtccaagaagcatgacttccacaacaccctcggatgctaacttcttcacctctgctacaatatcttccggctttctgcttcgctctcttcctcttacataaggaacgatacagtaactacagaagttattacagccaaacataatatttacgccagccttaaatccaaacttacggtcacttggcaggtcctcaataatctggtctgtcttctcccagacatcaaatactctctttcttccagaaaggcattcatataaaagctctgccagcttaaaaatattgtgagttccaaaaaccacatcgacaaacttgaatgttgtctttaccttttcctgttcctccggctcctgcatcatacagccacacatggcaataaccatctctggattcttctttttataattctttaaagcaccaagtcttccataaacacgaacattcgcattctcacgaactgtacaagtattatagtagacaaagtcagccttttctgtgtccgctttcacataaccgatatcctcaagaataccatttaacttctcagaatccttaaaattcatctggcatccaaaagtctgatcatagaatgtcagcttacgtccaatctctaattctctttcctttataatctctctacactttgcaataaaataccgctgtctctccggttcctgttccggtgcaggcgcggtcgtatcaattaattcatagtttatattcgtcattataattatttaacctccaagtgtgtaaaatcaactttttacgcagatagagatattataggataactttttttatttttcaagaaaaaagtacttgatttttatttttgtctgtgctatattagacaagtcgcaacgatatggtcgattggtcaagcggctaagacgtcgccctctcacggcgaaaacaggggttcgattcccctatcgactatttattttttaaaacaaaataaaaaagtacttgattttcactttgacttgtgatatagtagtcaagtcgtaacgacatggtcgattggtcaagcggctaagacgtcgccctctcacggcgaaaacaggggttcgattcccctatcgactatttattttaaaaggtttgtctgtctaggcaaaccttttttgtttcataaataaaatcctttcgtttgccataggcggaaacccactacctttagggacgccactgaaaaagtggtaagtttagtatcacagggcgtcaaatatatgccaaaatgttccttgataataaaatattgctaaaatagtgttttgagggatgcaaaatctacccttttgagagatgaattttcctattttttctcatttgggcagacttctccctttagttttaaaattcgttttaaattgactgcaaatattgatactgctccttgaagttgcatgtttgatagtccagcagcatcacaacgactatatccgtgtatattttttaattcactattttttgcctctatcatatagcgggttttgaaacgttccttgaaatattgtgttttttgaaacgcctcttgatttttatgataatccgatttaatagtgatactatacgttttggtttttgcattttctttatagcagccattacgataaggacagacatggcatttattaatatcgaaaaaatatttgatacgtgtattctttttctgattactacgtttgtcaattcgatattttatagccaaatgccctgctgggcactgcatggtatccgcatctttattaaagataaagccgtcctctgaacgagtcccttttatgatgctcgggttaagctttgaaattaatttatagtcattgctttgtgcatcttttaaattttccagtgtggaatatgcggtatctgctattacttcattaacggttgcacctgctgctttacttttttgaaccagtactggaagttcctgaccatcaaatgcttcgccggatgtgattgttgctgcagtgataatccgttcatctgtcatggccaaatgagttttgtatccgtaaaaagaagaattgaccgttttatggccaatccgggcatccgggtcaatggattgatcataacaatcaatctgattatccaaaatttcggataacatagaagattcttctttaatcgttggcagttctgaatacggactttcctgaactgtgtttaataattcatgacagtattcattatactcatctaaagaagctcgtttttcaggttcatctggcagataaatgtctttatcagaatcttttaaagctacttttaaagaagtagaggcttttttcaacatttctctctgagtagttttatgataacgggcttctgtatgagttgagtcaacaattatagtattgctttttaaaacaccttgatttatggcaagttctacacttttatttatgagcagatcaagtatattttcatcttttaaacgctgctttctgaatttggttaaaagactaggatggataacctcttcttctggcgttaattccagaaaatatttaaaagacatatcatatcgtgatctttcaacaacaccattatcagaaaggttataaagatattttaaaagcagatatttaaatagcaatataggattttttgcattacgtccattatcaaggcaatatttattttttaattcatcatatataaaagaaaaatcgaccaattccctgatttttcttagaatatgatcttttggaacaatcatgtcatataaatctgaataataactaaggctaagtttaagttgggatgataacatttcaacctccgacaattatgataccttaattatatcagatatatgattttacgaccactttttcagtggcgtccctttaggtggtgggaggagccttgttaactgttacccaatatgctacaatagccgtagcagttcttaaagagaaaaccgttagatgtgctgctcattaaagacactcttttgtacattgacaagatatgaggttgcaatacgaaattcgtgtattgcgtaaaatcttaaccgtaaaagatttttttactgtatagcatgggaagtttagtacctgatacagttacagatgagcatgtcttgtctgtaaagggtgctgtcagtcaccctatgatgtaacgccactttagatagcaatatctatcggggattaaaggtcggaggtgtaagccgttagtacgactgggcagttacaaacccatgacctttaggtcgtgggtagttgacaaaggaggcacttctatggctttttttgacaccttaaaacaaaaccttatgactgccagccaggttacaatggataaatcaaaaaataccgctgagattttaaaattaaaagaccagattcgccaggataaacgagagattcgttctgctacttataaaatcggggagatttatcgggagcttcactccgaaaaccatgaagaggcttatgaggattgagtgtttagaacaggcgattgagtggaaggaagatgcgctgaagaatttgaaacaagaggattaattgctctctagattttaaaaaaacagacggaaataaaaaaatagatatatagtatctgttccatatcactgcacgaataatgcttacccgcattattcgcttgctccaaagtcacagatactatatatctatttttttatttcctgtctttgataaattggagaggttattcaaattttaggttactacttatacttttaaacgcctgtccttggctacttctctccttctatgcttaacaagaaatctattactccgttcctactatttttaaactgtcgccctccgataatgtaaaaatgcccgtacatcgacagaattctacaaacatgaaaaataggtgattttgtttctctttcgtagaattaatgaaggagatatggtaaaatatttgtaaactttggctggtcaacagaaagtggggaaataaggtagaaaagaagcgggaattcgggcgatggattaaaatagaaacatattggaatgtaaattccttttgcaaagtaggcaacatcggctgttgagaatttaaatagggacatatcggaatgtaaatctaaatgaaatgtaggtagcgagatgaattgtataatttaatagggacatattggaatgtaaattcagttccagccgctccatgtcttcatcctgcggatttaaatagagacatattggaaagataagagcaaacaatttaatatcaaatcatcatattatcgctttaaattcataaaacaatttactttatcacgaaatcagcataattcgtcagaaaagcaacaaaaataggaaaatatgtgataatataatcgaaatgctatttatttgtttaaagactaacttagaaacaaagttttttataaataatgcgatagcgtgagaagcaaagaggtaatgtgataatttggaggtgttttgatgattcgtcagacaggtttagcacaggcaattgacatagcagagaatcgtgcaaagtacgatgaatgtgcaaagaaattactgagctataaggcaatcatagcgtggattttaaaatcctgtacaaaagaattttcacaatacggagtgcagtatatctgtgataactgcttaaaagaagaagccgaggtatcaacctatgcagtacatcaggatgaattagataagaatgacaaactggatggagacaaaagagtggaaggcatgaatacggaatccaactcgattcaggaacatacaatatattatgatattcgtcttccggcctttctgccaaagagtaacgaaatagttcgtttgatccttaacctcgaaatacagttagatgatacgccaggatacccaattgtaaagagaggattttattactgtggaagaatggtttccgaacaatatggaactgtatttacaaatgaacattatgagaagctagaaaaagtctacagcatatggatttgtccagatccggcgaaaaaacgaaagaatggaatttttaaatatcacacggtagaggatataatttacggagaatcctatacaaaagaggagaattatgatttgatggaggtagtagttctcaatctgggagatgcagataagagtagtgatttagagatactagatttactgaatgtattgttctctgcgacgacaacaccagaagagaaaaagcagagactaaatgatgaatttgagatagcgatgacagtagaatttgaaagcgaggtgcaggagatgtgtaatttaagcaaggctcttgtagagcagggaattaaacaaggtataaaacaaggcatagaattaggaaaagaggaaagaactctatctatggcgcagatgatgatacaggaaagagaaccgattgaaaaaatagaaaagtatacaggctatacattagaaaagttaagagagatagcaaccaaaataggaataccattaatgacggaatgagacaggaaatatattgaaatgtaaatagcatatacatcttttagcatcattctcatggtagttaaaatagagacatactggaacataatatttattcccccgccaaagacagaaaactaattattacaatacaaaggattttcacttatgaaagaaagactcatttttcacgttgacgtaaatagtgcctatttaagctgggaggctgtccaccagcttaaaaatggtgcttctacagatatccgaacaatcccatcgatcatcggtggcgatacttctttgcgcaaaggagttgttcttgccaagtcgcttcctgctaaacgttttcgtattcatacgggagaaccggttaccgatgctctgacgaaatgtcctactttacaaagttttcaaccgaatttccctctttatcacaaatattccaaagctttcatcactattttaaagaaatatgctcctgtggtagaacaggtttctattgatgaagcttaccttgatatgagcggacttcactacttctactctactccgcttgaagctgccgaaaagattcagaccgatattagagaaactttagattttaccgtaaatatcggcatttcttcaaataaacttcttgcaaaaatggcttctgattttgaaaaaccagacaaaatccacactttgtttccatctgaaatagaaaaaaaaatgtggcatcttcctgttcgcactctcttttttaccggaagagctgccgcacaaaagttaaatcagctcggtatctatactattggtgacattgccaaaagcaaccctgactttttaaaggcacacttaaattctcaaggagttactttgtggaactatgcaaacggcagagacaattctcctgttaaagaatctcctgatgctccaaaaggctatgggaattccactactttaagcaaagacctcacttcgctttctgaggcgaaacctgtcttattagaactctgcgaaaccgtcactaagcgacttcgtgaagatcaggtttacgcacaagttattgaagtagaactcaaggacagccattttcgcaggaaatcccaccagacagtccttgattactctacaaatactactgacgacttttatcaaatcagtgtaaaactttttaaagaactctgggatggcaccccaatccggcttcttggagtacgaggcggcaaactcaccctcgacaaaatcgaacagatacaacttttcactgaaactgcctcctcacatgaaaaacgggaaaaaatgtcaaagctcgatgcagcattggattccatacaaaagaaacatgggaaaaattcaataatgagggcgagtaaattgtgatttgccgcaggcaagggagacactcccaaagagagacaatggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgagctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatatttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgagcaggagttcgataggtatgccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgcccctttcagataaacagttttatttttttcaactgtctacctaaaagggagtggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgaggctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttctttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccacaatacgctatatttgtgactttagtcgctgcaggttgaatgttcgcttatgcgctcgcatccaccctctgctccgaggccacaaatatagcgtattgtctctctttgggagctgtctttggctgttggagcaaaatcagaattcatgttggagaatttggggattgtttagaagattatatttgggagagaatggaaaatgggctattaaagattaacgtaatctattgttacaatgtcaaggcaagaatatagtaacatcaaaaagtagcttaataaataaatccccaaaagtcttccttttggggatttatctctttattgattaaattataaattatttgttctataccactgtaacatttcatttaatttttgacggaacaaattattactttcctctcttaatctggtatcttccatcaaaatgccaactggtgttgttgttagattcaatccttttaaagtaaacaaatgactattttctatttttctcattgtctcatatttaagagatgacacaccatatgggattgtaaaagtttccgttaatgtctgattcccatcagcaaatgtccaaagacaggctattttatggggaagtccattgatttttatatccacctttttcccactatctaccgatgctatctttcgtccatcaaagataatctcacatcctattttatttagacaaaattgctttgtacgcgaaactactattgttcttgttgtcattttaagtttattttcaataaactctctctctttttctgttatttgattcataaaaccctcctgtataaaaattatattataaaatgacaaaaggctaccaaacaccctgtcataaatacattcatcagaatagatgattcatttttctggcccattccaaaaagtaatccattcgcttccccagcaaaaaagagaactcctcctactaatattgaaataacatatcctaacatccatccaaacgtagataatccagttgccctggctgttcctgctgcaaaatgatgtataagtttataaaaaaaggctattctagcaatatcaagagcaaacgatataattacaataaggacattatttttgtacttatataatgcaaaatataaatcctgaattatatctttaatcaaaaataaaatacaaatcactcccagaatagctaatacaaatttggtagatgcattaataaaaacaatagaaaccagtaatataaatgccaataccaagcctaaattaaaaaatattacaaccatacttcctccttgatttttctttaataataggtcaatttcaccctaaagtcaataggtcagtatgacataattcttcaaaaaaggagttcttatgtctcgtttaaaggaattaagaaaagaaaaaggttacacccaggtaaaaatgcaattattaacaggaattgatcaaagcgattattccaaaatagaaaatggaaaacgctattacacatttgaacaatgtagaaaaattgcattggcattagagacaagcatggattatcttgctggattgactgatgaaaagaaaccatatccacggataataaaaaaataactttaaattttgaatttaccgaatgccaaaattgactcacccaaagagagacgataccctatatttgtggcctgggagtaaaggttgaatgtgagtgattaagcgaacattcaacctacagcgacaaaagtcacaaatatagggtattttcttccttgaggcgtcccccttgcctgcggcaaatcagattttttctctttttgttgttaaaacaacggttttttcttctcatctatattacaataacacagaaccaagaaatccagactgtcacaaagctttccacataactgtgacagtatttttatctcacataaattcaaaaaacaaaggagaactaacgatgattcgaagaattatacacattaacgaagaaaaatgtaacggctgtggtgcctgtgccgatgcctgccatgaaagcgcaattggaatggtgaacggaaaggcaaagcttttgcgtgatgactactgtgacggacttggtgactgtctgccagcctgtcctactggagcaatcactttcgaagaacgtgaagctgccgcttatgatgaagctgcagtaatggcaaataaacagaaaaaagaggcttctgccattaatactgcacagtctgtaccacaatctaacgaagcgaaaaaagcacacacagctcacggttgtccaggccagcgtatcgcacagtttaaccgccagaacacagcagattctgcctctgataatgaaactacttctacacctgctgcaatcacctctcagcttagccagtggccagtgcagattaaattagctccagttactgctccatattttaacggtgcaaaattgttaattgctgctgactgtaccgcatatgcttatgctaacttccatcaggattttatcaaaggaaaaatcactctggtaggatgtccaaaactcgatgctgttgactatagtgaaaaacttacagaaattatcgctactaacgatattaaaagtgttaccatcgtccgtatggaagttccttgctgcggtggattggaacatgccgctgtgactgctttgaaaaacagtggaaagtttattccatggcaggtggtaacaatttctattgacggcaaaattttagattaattcagcaaataggaatttgccggggtgagtagacagacgaaccccggcaaatttattaaaagatttggggaagaagacaggagaatgagtctgcctgggaaactaaatttcgaaggattgacacaaaaatccataagaaaaaattattatttttacacattaaaataacaatatgagtgtcgaactcttatgattcaactttttaaaaagccacaatcttctggcgatttggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgccaaaaagaagccgctgttttcgattacctttctggaaaaggttctctccgggatatctgtgcccggcacaaaatttcagatgcacagatactcagaagatggattatgaagtataatagtcatgataaggaaacaggaggcagagcaatcatgactaaaggaagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattgaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacatagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggtataaaaatgttgcccgatatccaaccgggcaacacaaaaattttatatttttttaattgtctacttgacgggatgcacaccaattccccaaatcactccaacatgaaatagtaattccatctccagcaaaaacacagcacccaaagagagcaggtagcctatatttgtggccttagaacgaggattgaatgcgagcccggaggcgaacattcaacccgcagtgatagagtcacaaatataggctacctgctctctttgggtgcgtcttcttgcctacggcaattattatttcactggcaaattcctatttaaagctcatgaaatatcggttgcatcttctcaaatgtacaaaactgtgtataccccagtttgcgaagttcctccttcgcccaatcaatatacgccccaagatgctccttcttatgactgtcacttccgattgtaataattgtaccgccaagttctttataaagctttaatatatctcttgatggtgtcatatccgaaaggccatatctatgatttgaagtatttacttcaattccttttccatctgcaataaccgtctttaaaatctctgtgagaatggttttaatttttcaaacggatacacaccgtaactatcataacgcacaatcaaatccatatgtcctaacacactatagttgtgataattctgtacaacggaaagtaattctttatagtagccctcgttgtactcctgctgtgtgcgtccactttgatattcatttgtccaaaattcctggtctcctgcctgatgaatggacaaaatgatgaagtcaaatggataactgcgaaataacttctcatactctggaatagtatgtgtctgcaccccaaactctaatcctgcttttattgcaattttctctctatattttcacgcattttctctatcatagaaaaatattttttataatctacattggtaagggcaacttgctctggctccccttcatctcctggacgatactggattcctcttggatcatcccagtcgcggtatggaccatagtctacatggtcggtaaaacatatatccttgatacctaatgagatggcatcttttactacttcctccatcgggtaaatggagtcattgctgaattctgtatgtacatggtaatctgctaacatatttctcctttatccaatcgcttttctcatatcccttatctctttttggatttcctgatatcttcgctgtcttttcgcaatatttcccctctcttttcctgaaagttcttctgattctatctcttttatggactgtttcagctctgctgctatactttcttttttggtgatttctttttcgaggtattcttttaatactggatttttcgtttcaatcagatattttccatactgttcataaatactttccatatctttctctgaaactgcctgattcacttgtgtgtctgatatttcttttatatattcgtgaatggaaggctgctggtgtttcagtcgttgtggctgtgtccacgctggttccgctttaatgattacatagtatttaccatcttcttttaagaaccattctttttcaatctgatagcgatattcttttaagagccggcggatcttgaaccattcggattgtggctgcaaaataaactcttttccctctattaaaaattctggtttggcttttaatattttacagattaaatctccgcccatgcctgcgatgattacggtatctgtttctcctggctctaatggtgcaagtccatttccaagacgggtagctattttcccgccaagtttttcttccctgatatgttcctgtgctttttcgagtgggcctttattcacatccattgcaataccggctggtgaaagattatttttcaccagataaatcgggacacatatccatggtcagttccaacatctgccaccgatttcccttgttactgcttctgccactgtttttaatcgtattgaaagttccatttacttctgtaattcctcctaaattatactatgtaccggcgaaaatacgactcataaaaaatagcaccccaaaaaatttctctccccactgatactgatttgttgctcgctgcctacagatatgggagtcatctcacatctgatatatacgaacaaatgcttctattggagaaccatcacttggtctgctattttttattattctcttcctatatcattcttctaaatgtcatttctccaaagattactcttccaaaaaatctcttagtttcctgcttcttgtcggatgccgaagctttctcaaggccttcgcttctatctgacgaatgcgttctctggttacctgaaattctcgtccgacttcctcaagtgtatgcggtttgccgtcctctaagccaaaacggagtgcaagtactttctgctctctctcggataaagtatccatcaccttttcaagctgttctcggagtaatgtatgcgctgcctcatcagcaggaacaggaatgtgctcatcctgaataaagtctccaagatggctgtcctcttcctcgccaattggggtttctaaggaaacaggttcctgtgatattttcgaaatctcaagcacacgctccacaggcaggttcattgcctccgctatttcttctggagtcggctctctgccgtattcctgcaacagtcttctgcttgtacgattcacccggttcatagtttctaccatatggactggaatccgtatggttcttgcctgatcagcaatcgcgcgggtaatagattgacgaatccaccaggtagcataggtagaaaatttatacccttttctgtagtcaaacttttctaccgctttgatcagtccaagattgccttcctgaatcaaatcaagaaactgcatcccctgccggaataccgcttggcaatacttaccgtaagtcgaagattggcttcagaaagcttcttttttgcctcctcatctccctcctccatacgtttggccagctctatctcttcttcagaacttaataatggaatcctgcctatttcttttaaatacatacgaacaggatcttcggcattacctctttctgtaaatgagttctccgattcttctgctgttttttcatagcctttttcaatttctgcagttacctgtacatttccaatcctatctggcttttgaaaaacatccatatcgtttaaagaatcgatttctcccacatcatcttctatatcatccgcattaatatcgggcatagtcagtacatcgattttttgctcttccagataagcaataatacgctcaagctgtgcctgcgtcagaggactgttctgaaagacatctcttatctcctgaagttctaccacgttcttctgcttctttgctctctcaagcagacaattcatctggctgccaaaaatctgttctttcctgcccaaaatacaccctccaaatcttacatactccaggggtctgcttttttgattatacaaaatatagcaaatcccagcgtacattattcctgctcttagttttaccagctttatactcggtttatactaaatttctgcattttatttttcagggataaaagttcctgccagcgcataatatcactggtatgaaccatctcatcctcaatgcttgcaagtttcactttgcgcactacatctgaaagcgctttatcttcatcttcggaggaaagtccgtattttaaatgtgtattaaagattgccgcaatttctttttgttcttctgcatcggtaaatcgacttaaaattgctgccggatttattttctcttctttatctaattgttcaaaaagcataatcgccaccgaatggtacagcggctcaatgaagtcatctgccccgatatacggccggatatattgatacatatcaggatgttccacaagccaggtaagaagaagtctctgtggctggtttttcgtattttttttcttttcctgccgccgctcttctgtttccggtgccgtcttatactgctcattcacctgctcatactgatagcctaatccataacggttcacaaggttttcaaggtcattcttccttatcataaaacggttagccgctgatgtaagataggtctgccgttctaacggttcctcaatctgtgctaactttttcgccacttcatgaagaaactctgtccggctttccgggtcctgctgattatactgtccataaaggacaagcaactcaaacattcttccagattctgcttcatcaatcctcttctggtagctttctgctccctctgccttaatcagctcgtccggatctttatatggcttcatggataacacccggcccctcagaccattctgccgcaaaattggcagggcccgaagtgccgcctttattccagctccgtcactgtcaaacgacaaaataacttcattcgtgtaccgctttaaaagcatcgcctgattcggtgtaaatgccgttcccagcggagcaactgcattggtgaatcctgcctgatgtaacgagatgacatccatgtagccctcacacaaaataatcgcattacttcgcgatctctttgcataatttaatccatatagatttcttcccttatcaaacaaaatagtctctctggaatttagatactttggttctccatctcccatcacacggccgccaaaaccgattactctctggttcatatccataatcgggaaaataacacggttaaaaaacttatcataatttccctttactgtatcaatatttacaagagaggattccttcatctggtaatccgtaaatccctttgaccttaaatactgatataaatcatcccggtaaatgtctgcatatccaagtccgaaatgattaatcgtttcatcgctcagcccacgattcttaagataagaaagcgcctgtgttcctctctcactctttaaaagataatggaaatatattgccgcttccttattcatatctctaagtgtcactctggcatccgcctgctgtctttcctctgccgtctgttccctttctggaagttctactccggccctctgtgccagattttgcaatgcctccacaaaggagagccggttatattccataagaaatgtatagacatttccgccctgtccgcagccaaagcaataatacatttgcttgtcccggctgacagaaaatgatgggctcttttcattgtggaacgggcaaagccctacatagttcgaacctcgcttttttaacgaaacataagaggaaatcacatcgactatatcatttttttctctgacctcatcaatcagttcttcttcatatctcatctttttcctctttatctaaaacaattttgttcctgttagttacattatatgttgacaattcaaaattattatacaattttgtaactattcagaacgaattcgcatgtttatcgaaaatctgcaggattctgaatagttcaagaatgccccggtattcttgctacgagatgcgcgtcatgcaatgcatgacatacttattctgtcattctacacgtttttgaatagatacaaatttattttgaaaattctacacaattccaaataattgtgagcctacttatcctgattcaaaaccgcaattgcatcaagagatactttcataagctctcttacttcttcctccgtaattcccatacgttctgcgatttctgacggttttgcctctctttcatactcttttgcaaatgccgtcgcaatatcattcatttcattcacacggtttgccatctttactgcggaacgagtggaagaattatattcttctaatgtctcctctaaatgtttgcgaatcattttctcagaaaatgcatggaaatctttatcgatatccggctcaaattcattcacagcaaccatcagcccaatattgccctcctgaattaagtcacttaagagaagtccccttccctcgtattctttggcaatctctactgcgcgggaaagattcgcttcaatcagcaggtttcttgccgtatcatcaccgctgacaagctttcttgcaattactctttcctgttccccagataatgaattcgctttttccatctcttttaagtaaaaagctacaatctctgcatccatcggatcttctttattcggaatctcctcgtccccgatttcttcctcaaatctttgcacacgattcgtaatataaatgtggtgggattcaaaataattacatataaaatcaagctgtttttcctctaacttcatgtcagaaaaataagaattgatttcttccatagataactgattgccgtttgtctctccaagacgttctaattcctgaattgcctgtaaaaattctgtctgacctgccatgactttactcctcctcttttgcggtctttttttgttttttcttttcctgtgatttctcatccgctggaaatacgatatgaagctgtcttctcgcctcatctaaaactttcatggtctctaaagtaatctctcgtgatttctcccatcccatgcccgtttttatcattttaataaattcctgtgtctcataatttaaaatattatcagactgttcaaaatgaatggactgtaccactccttttctcacgatgcgtaaatctttgatattctcaatttcctgcacaagcatggaagcatcttctccctgaatctgacttggcatcgctgaatctgtaatcttagaataaatggcctctccaatcatatccggatattccataagaattgttcctgccccatccacaccattggaaagcttgattcctgatgccttgatggaaactggtgcaccgaaaagccgaatcatgcaggccaccacatacacaccgatatccattaatgctccatttgataattccggtttaaatgcattctcaataattcctctcttataattatcataacgggaagaatactgacaatactgtaaggttgctcttcgaatcttaccaagcgattccatatacggaagcatcttctcaaagcttggcgcataaatagaacgcattccctctaaaagtatcagattctgcttctcagcttccgaaaacatttcctccgcttcttttaaattcgaagccatcggtttctcacacaaaacatgcttgcctgcttttagcaatgtcataacctggtcgtgatgacagcagttcgggcttgccacataaaccgcatcaatacagtcactgtttgcaaatgcctctaaatcatcaaaatattgcagcctgcctttctgaaaaccaaactctctcgctctctctaatgttcttgaatacaccgctgtaagttcaaaatcttttccatagcggtttgcctgccagaacttctgtgcaatcttccctgttccaatcattccaaatcgaatcatttttgtttcctttccttctcctcctgtccgtccttttaaacggtcataccaggtaagattatccgggttttctccctgttttctaagatattcttctaacaacttcacatcttttatgatatgatctgctccggcttttgataattcttcctctgacccgtaaccgtaaagtacaccgacagattctaagccacaaagctttgccccctcaatatcatgctttctgtccccaatcatgatggcatcttggggcttaatctcacaggtctctaatatgtaaccaatgacttctgcctttctttttcgtgtgccgtctaattcgcttcccccgacaaaggaaaaataatcgctaaggccaaaatgttctaatatctgctttgcaaatacagctggctttgaagtagctacaattaatgtaaatcccgcttctacaagccgacttaacatttctggaattcccggatatacctcattctcaaagattccctttggtgcaaaatactctctgtaatattccactgccttcccggcatcttctttagaaagtccataaaactcctgaaaagaatcatcaagcggcggccctataaatggaatcagatcttttaagtactttacatgaatcccgaacttttccagagcatactgaacggaggaggtaatgcccaccatcggatcggtcaatgtcccatccagatcaaataaaagatattgcttcaatatattccctctcccttcttcattattacctgtctctaattataaaagaaaaccgcataaaacacaaacatatttttacaccatgattgacaatacaacctttataaaatataataatacaaatatattttttttaaaaggagatgatgttttggaccccagttccatacgccaaattgtgattctgttaatattgttactgctttctgctttcttttcttccgcagagacagcccttactacggtaaataagcaccggatgcgtgcccttgcaaatcagggcaataaaaaagccgccagagtgcttgctctgatagagaagccagaaaagatgttaagtgccatattaatcggtaacaacattgtaaacctttcggcttcttctctgaccaccacattggcaatgagccttgcatcacaggcaggtcttggaaagaacaccagcacttttgttggtcttgcaacaggtattcttactcttcttatcttaatttttggtgagattaccccaaaaacaatcgctactatgaagaacgagagcatggctcttctgtattctggaataatttatacgattacaaccgtacttactcctgtcatctatgtagtgaatcttttcagtggtcttttatgccgtttattcgggattaaaccaggaagcggacaggctataacagaattagagcttcgaacgattgttgatgtcagtcaggagagcggcgtaattgaaaaagaagaaaaagagcttataaataatgtattcgatttcggtgattctgtcgcaaaggacattatgcttccacgtattgatgtctcttttgcttccgttgatatgtcctatgatgagctggtcgagattttcttagaagaacagtactcaagactccctgtttacgaggagagtaaggacaatgttatcgggattcttaatttaaaggatttattcttttaccgggagacacaccgcaatgaagcatttgacatatacaaggtactgagagaaccattttttacttatgaatatcagaaaacctccactttaatggaggagatgcgcaataactctatcagttttgccatcgttcttgacgagtacggttctaccgcaggacttgttactttagaggatcttattgaagagatcgtcggtgatatcaaagatgaatttgacgagtccgaaacagatgcgattcgttgtatcggcaccgatgaatatgagatagagggaagcaccaagcttgacgatctaaatgatgtccttggtacagaaattgaatccgaagactatgattcaatcggcggacatatgattgagcttctcgaccatcttccaaaagaaggtgaaacagtaaaggaaggcaattacctctattcgataaaaaaaatggataaaaaccgggtggaaattgtttatttaaagattgaacggcacacttctgaagcgaagccagcagagatgtaagctatttgccacctctagagcgtgtttgaaaaatcattcccgcaatctgcacgccccaatttgcgggagattttgccttcattcagttgatgtagcccgctacgccgccctcattcaggctaaatctcccacaaattgtaacgtacatcttacagaaagcatttttcaaacacgctctagatccgaataatttccagagggatttattcggatcttctttttataagggttcaagctaattattttaattattacattttctatagaaaataagataagaaaggacaacaactatgattacggacaaacaaagacagcgtgattatgagtatgaggcggattaccagtccaaaagccgctacacaacagaacagtggacaaatattttaaattccggccagcttgacgaaaaaaatatctccctgctcaaacagatttattcttcctttaaccatgctgcaacacttcttcagctttcttttgagagcggacgcacacaggaagacattttatcgcagttaaattctgccggtcagcttcttggcgaggcaaacagcatgaacccggaagttgattacgagggtaatgaatactggtggtatcttttcttctggggaaaaaataccgatgcaaaaacactcgaattaaaaatgcatccagaactgacagaagcaatcggtacattatatcctgaattagaagaatcctattatgcttttatgagtgatgtggaacgaagcctccagactcgttacagccaggaagatgccgtatggattgccgccgctgtccttctttacgaaaaatattactgcaacccgggaatcagttctgatgatattctcctaatgcaatatgaggtgcagacccgctcccagaaagtatatgggcaggatgttaatgctaacaccatcacacagatctgtaacgctgatgagcgtggtcaccgttttaattatttaagagatatttacaaatattatcgtgtatcttttcctggggaatttgagggagaacgagagcgcccagacccggaagaagtggattatgatgcatatgtctactctattctcggttacatgaagctttctaaacttaccgactttattgagcatgagtatgcgcaccttgtcgatgaatcttatgtggaacttacaaatgccaatggattcgtccgcatggcagcctatttatcaagacagggcggcactccattttctctggatgatacttccgataaggcactttccctccgtgccgatggcgaagatgcttccgaaacatttcacaaaataagtgaggcacttttaaaagaatatccgaactttacttatgccgcaaaaggagactggtatgtcccagaatccagcactgttaccggcgttcttcaggacattttgtatatcccgtcctatgccggacataacgctttcatcggtatccgcaccgtattagatgaggataaattaaatatcgaagtttctctgaaccttccttgcgtttctgacgaggaagtcatgctcgatattcacgacaaatgcaatatgctcaccctgatgacggcagcaccatttcaggtgactctcgtgccttctgaaagttctgacttatctccatccggtgataaaataaaggcatttgtcctctatcattatgatgactttaaaacaatgtcagaagaagatatcgtaggactgttttctacttctttagaaatctttgcttcctattatacagatatttgccagaactattatcctgcgatagaagatgacggaaacgttgaaattggaactgaaactggagatagcagtgaaacaggaactgactctgtcaccaatcctctggcggcagcactcggctctaaattaacttaccgtcctgctgctgatgtacaaggcccacagattatttataaagagggcggcacaccagcgtccactgattttatcacaaaagccattcaaggttatggaacaacaccagcctctgatgagagaacttatgaaaatgaaacagcttcaaacatctctgcagacagcacctctgctggcgatgaagaattttcttcttttgtaaataaagcagctttagagggggatgacgaagaaatcccagcaagaaaaaccggaaactattctggcagaaacacttctattaccggagcaggttcttctgctggcagtaaccgaacttccggctctggttcgatgaattcagcctctgctggcttctccggcaatagctcttttgcttctgatgctgcctcttcagccgcagcggtcggggctgccacaggagcaggcagcggcactcctgttacagcaaatgtttccattaccccggattccgtatggccttatcctgacaatgccatcgcttccacccatccagaccgtaaagagcagaacttccgcctctatccaaaaaacaccctaatcaaaggtccggtaaagacaggaaagttccatcaggcaattatgactgctgtcggtattattgagggtaaggactccaatatgatgaatattgaacccgtacctgatgtattagagcattaccagcagtatgttgatgaaggacgaatccttcatatctcttaccctgacatcaacagtgacggctacgacggttttatcgagagaaaacgcggtccattcatcgaggatggcattttcaaacaatttgccaataaatgcgccgacgggcgctatgttgttatgatggaagaagtcgatttaaactggatgcaccttttcagagaaactgccgttcttttacgcgagaaccgccgtgaaggcaccagtagcgaaacagccataacgcttcctttttctaaagaaaagtttcggttgccttcgaacctttacatcgttgctacctgcgattccatcgtctgtgaagacactattttaggagcaattgaccacgatttcttcatccgtcccgtatctccagaaccggaaatcctacatggtatgcgcgtagaaggaatctccctgcagcgtcttatgacaaccatcaatatgcgtctctcctactttttaggtgcagactaccagcttggcgagggattcttcctgcaatcccctgacaaagacagctttatctctctttgccgggtatttagagaacagcttgtcccactccttgaaaaatggtttgacggcgatatcgaacgtatccgctatgtcttaggcgataatggaaaatcccgtccggatacgattttctttcaggaaattccattcagagacggactgttcaaaggagaattgccggattcctttgataaggagagacggatttatcgctgtaatgaagatgctttttacaatccgaagagttatatcgacatttatgattaaattctgatttgccgcaggcaaggtagacgccccccgaaagagacaatagcctatatttgtgactctatcactgtgggttgaatgttcgcttccatgctcacattcaatcctcgctctaaggccacaaatataggctattgtctctttcgggggctgtctttggctgtagaagcaaaatcagaattaatcttaaaggatttggggattctccaatagattgtgctttcccgtaaaatgagatattaaaaattggcatataaactatagttacaattttgtaaaatctggagtaaacagccgccataaaagtttttgtgccggatttctcagaaaaaattgaaaaagaagtggctattctaagcttgaattttgcgactttgcgctgtggaattctgactgtaaccttgcgagctcgttttcgatgccttagcaggtcgaaagaagctccagtggaggttccttcgagccaaggttgtcctatcaggcagaatggaacgtttagcgcaacggaacaaaatcaagcttagaatagccacttctttttgaagttatctaggaaaatccggcacaagatatcttctatagcggcgtctcctttgctacgcaaatcgcaaaaaccccgaaagattatttatctttcggggttcgtcttttttatgtacttaattaaaaaattctacgaattgtcacgatagaacgatatgcagcacctttcgtaatcttgatgccatctcttggattactagcatggattactctgttgttgcccatgtaaattgctacatgaccgctgtaacaaataatgtcaccaggttttgctttgcttaagcttcttactcttcttccaacgtttctctgtgcataagaagaatgaggaagtgacttaccaaaatgtctatatacactcataacaaatcctgagcagtcagctccatgagtaaggcttgttccaccccatctgtaaggatttccaaggaatctcttcgcatagtttacaacactctgacctttgctcattgtagttgcagaagcggttgctccattagcgattgtgatatatttaccctgtgtataaccaaccttaccttttacttttaccgcaacccacttagagttgttagaaaggagtgttacttttgctcctctttttaaagtagtaatcttctttgctttcgtactctttcttgtacggatgtttaaaatactagagtttactttaccttttgttactaattttgcagcctctacctgtgctacattatttacccctgacacaggagctatattaaaaagaaagactgcggtaagtaaaccggctgccacacgtttcattctattcagcatatttcattcctccacaaattcataatcgaacatttatctaactgaggctcattataactgttgaatgtgtccaaaatgtgacttttgcaatattttttaataaaaccgtaatatccaacaataaaacgataagattttttctaaaatataagcacatttttgcttatctgtaaacaaatcatgacctttcagccacaattaaaacactatttactctgggaaagcagtttttgttttaactcatcttcaagttctaccagcttgccctcggcttctcttctcttttcccggccttcctgctgaatcttcatcacttcatcaatagtgctcataaggctctcatttgttgccacgagagtttccatatcaataattcccctctcgctttcctttgcagtttcaatagttgctgtttttaacttctctgcatttttcttaagaaggtcattcgtaagatccgtaacctttctctgcgcttctgccgcttctcttgaatgttctacaccgagtgcgataatcatctggctcttccataaaggaatcgtatttacaagagtagactgaatcttctcagacattgtaatgtcactagcctgtaccatacgaatctgtggagccatctgtaaagataccattcttgtaagctccaaatcatgaatcttcttttcaaaacgattacaaagtgcctctctgtcattaacttcctgcacatcttcctggcttcccgtttcctgcgctttttttcgaagtgccggaagaacctcattggtttctttctcaagctttttctttcccgcaagaatgtacattgtaagctcacggaaatatactttatttaaatcataaagctgatcaagcatagcgctatcctttaaaagctgtacctgatgtccctctaacttctcacagatctggtcgatgcttccctccgctttactatagcggagtttcaatgtctgcgcttttgatgcctttttcttaaagaaaccgacaatacctttttcttcttcctcatcaaatcctttcagttccacgacaaccccatttaacagatcaccgatttctcccaaatctttagaacgtactttttccagtgttccttctgaaaaatcagacatctttttctgtgttcccgcaccatactgtaaaatggatgtggaatcttctagctgaatctgttctacaaacgcatccacctgtttcttttcttcttctgtcaaatactgttcttcttcataaactttcggctctgcttttttctcctctgctggaagttccggtgccgcttctggtgtcaaagtaagggatgggccttcttttaataattcttcaatatccatatcttcattctccttatatagtgtttatttgctatttcctctgctacttttttagattctttcaagaatgcctcggcattcttgctgcgagatgcgcatcatgcaatgcatgacatacttcttctccaacactgctgcttaaaattttataacttcaacatcggctctttctggtctgcatgtatcccgtcttcagtcaaaccatcctgcttcaacataacctctaatacctgaatatctgaagagatatccatggctacattctgaaacatctcatcaaataatttttcaagagcctgattcatcgtatctaaggaatcttctatctctttttttgttttcctgatattctctccctgaaccggctgtttctccacatcttcatatactttaagaagttttaatacagatggaaaataatatttaaacagcctgtccgtctgcgaaatactttctggatgctccgatgcacatacaaaaatacgggcggtaagcgtttccatctgctcaatcttcctgcgcatctcatcagacacaatctctttcttaagctctgcgagctgctctaaatactcctgcccatctttttttattcgatggatttctctttgctcaaatggagcagcctttagtgcctcttctgcctctcttgccttcacttcttcctgctctcgctgtctttttgcaaccatagcacttgcatattgctgctttgactcatccgtaagcataagacacgtttctcccgcatcaagttccgctccgataatcaattctctatctgtaaggaaatgaatatcttttaaaattttcttcctatcccatcctactctgctctcaagatcctctatcataacatagggctttcctgtccaaatacttgcatattttcttattcttcttgctcttttactgttaaaaatacctcttccaagtaaaaatgcactgacaatagtaaatggaatcataactgccacggatgtaattgctgcacctatgggaaatgccactgcccccaggaatgctccaagaccaatgcctgcgccaccaaaagcgccaagtccggcagcccctactgcaatttcagccggtccactgtaaagccccggattcttcttaagctttccggcaatgacctttcttccatgtccgacattcacatatgcctggctgctttgatatccccttgccttatcaatctgttttgcggcctcctcttttgctttatccacctgtctggcggcttcttctttcgcacgttcaatttgctttgctgcctctgtcttggccttatctacctgtttcattgtttcttctctggcaacatcaattgtcttttgaatattatgactcaattctgcaaaatccatagattcggtagattcctgtatcatggaaaaaatcttatctccccagtttataccatctgccttgccattatcattcttgtcttcagaggattttctgtatctttccccctgattcccgtgattttcactatctgaaaaatcaaatctatcttcctgattactcatatacatactcctaccttatatttctcttactatatcacagattttatcgtttttatagcgtagaatttcttacaaaggaattttccatctaatttatgaatatactaaaagaaaaacgaggaaatcacttggcaatcaaaatttatattgatcagggacataacccggagggaattaatgcaggagcagaaggttttggaatacgagagcaggatgtcacttatcaagtgggacgttttctctatgacattctatcagaagatgaccgatttgaggcccgcctctcacgccctacgccacagaccaccttaggatacagcaatacaagcagcttgagggaacgtgtgacgcaggcaaataactggccagcagattattttatcagtattcatgcaaatgccagcgaaaatcctgacataaatggaacagaagcttacgtctcttccacagattccgcagcttggtatctggctcaaaatattgtcacagaaatcgtgcgtcgcaccagtacaaaatataatggtgtattttccagaccttctctctacgtcttaaaaaatacgaaaatgcctgctgttctcgtggaacttgggtatattacgaactatgaagacaatcagcgaatgattaatgaaccttatcagttcgcatatggaatttatgtgggacttctcaattatctgggattaaaacaataaaatagcaatttcatccccagccccaaaaaaacagctgccaaagaaagaagagcccctatatctgtgaccttagtggaggattgaatgtaagccatttagcgaatattcaacctacagtgacagagtcacaaatataggggctcttctctctttgacagcatcccctttgcctgccgaaaataagcttctaacccagattcctgattttaaagtctctttccgcctctcgttttgcgtcctttttcgcgatatcctgtctcttatcatacagtttcttaccgcgtgcaagaccaatctccaccttcacgaggctgcctttgaagtagacttttaacggcattaaagtatagcctttcattttaatctgtccagcaagtttattaatttctgacttatgaagaaggagctttcttacgcgcagcggatctttattaaagatatttcctttttcataagggctgatgtgcatatgattaatgaggatttctcctttattgcttattgttacaaaggattctttgatactgcatctgcccatgcgcagagactttacttccgttccgtggagggcgatacctgcctcatatttttcatcgataaaataatcgtgatatgcttttttattgttggcaattaatttaataccttctgattttgccatattaattcccctttcctgttagagtgtatttaaaaaatgctttttgcaaattggggcgtgcagattgcaggaatgatttttcaaacacgctctagatttcgtcaattttctttttactataaagatgcagcaaacggtccgcttcctcatcgtcaatccagtcatttaaaagaataccgtctttatcaggaagactctctcctgtttcgtcaaattcggattcttcctggttcgctggatattctccgtccacaaactcaaaatcttcagattctgtattctctttctttcttgacggcattccgtctccatagtaatcatctgggtctggatactcgccatactgagagaattcttttaatataaagtcaatggtccgctccattttatcggcagagcgaactacgatttctgctttttgtcctaatgtaaagattcttccggtatgctctccggtcagtttatagctttcttcgtcaaatacatagaaatcatcaagaaggctgttgattggcaccattccctcgatagtattgtcaagttctacaaaaaatccccaggaagttactccggagataactcctgtgaaaactcctccgatatactgctgcatatattctacttttttgagcttatctacttcacgctctgcgtcctgcgcacggcgttccattgtagaactctgctgtgctacagatggaaggattgactcataatgttctaaccgcttctgatttaatttaccgtgaatattctccttgatgatccgatgaatctgtaagtctggataacggcggattggtgaagtaaaatgggtatagtactgtgtggaaagtccaaaatgtcctacatttaatgtggtgtactttgcctgcttcatggaacgaagagcaaggcggctgattaacggttcttccggctctccttctaaagaaaagagaagcttctggatttctttaggatgaaaactctcccttcctgtcttcatataatatccaaagttgtgaataaatgtatcaagcttcttgatcttatcgctgtccggtgcctcatgagtacggtaaacgaacggaatttcctgccagaaataatcttcggcaacggtctcattcgcaagaagcataaagtcctcgataatgtctgtcgcaacatttctctcatatggatgaatatctactgggtagcctttttcgtccacaacaatcttagattctgggaagtcaaagtcaatggctccacgctttctacgcttttcttttaagattgctgccgcttctttcattaagaaacaaagggcacgaatgtcctctcgtttgccctctggatgggcttctccttcaaggattgcctttactcctgtatagctcatacgctcatcaacacagattacagattccgtaatcgtatggtcaagtacattgccggacgcatcaaaagtcatcatgcagctcattgccagacgctccacgccagcattcaaggaacagattccattggaaagttcttttgggagcattggaattacccggtcagcaagatagacacttgtcgctctctctaacgcttctttgtccaatggagaatcttcctttacataatgagatacatccgcaatatgtacaccaagatagtacttatcctcttttttagaaagggtaatcgcatcatctaaatctctggcatcttcgccgtcaatcgttacggtaagaaggtcacggaaatccgcacgctttccaaccggctgttctgtaatttcctgcgggatagcctgtgcctcctttataacagacttcggaaattcttcttcgattccataagcacgaacaatacttgtcacatccgttgccgggtcatccatcgctccgagaatctcaataactgctccttctggcttcttacgctctccaccgaagtctgtcaggcgaacaacaaccttatctccatcttttgcaccattgatgtgcttcttggaaataaaaatatctttatcataatgacggtcatcgggaagaacaaatccaaagcttgtattcttctggaacgtaccgactaatgtcttacagccacgctctaaaatctttaagatcataccttcacggcgttttccttctccgccagtcttctttgttacctttactttgacaacatctttgtgaagcgctccgttaacatacgttgccggaatgaaaatatcctcttcttctccctcagccgtcacaaaaccaaaaccacgggcattcgcagtaaacactcccgtcacgttctgattctccggtttgatatacttgcctctggcggtaagttccacactgccgtctgccacaagagcatccatcacttcttttaatgcccctctgtctttatgtggcacgtccataagatatgccatctcttttagctttaatgggatataattcggatcatagatcatatccctgatactgtttttacgctgttcaaataataatctgtctttcatatactagtttcccctatcaaaactttgtcaaaaaaagccgtctcagttcagcttgcgaattgagacggcatcattagtctgctttaaaattactggaaaaccttcaggcaaaggccgatggctactacaaagaataaaaatccaagaattgctgtaattctctccaacttaccttctttagtccgaccacggttctttctaacataagaatcagaatcaacctgtccgcttaacgcaccgaaccctgaattcttgctttcctgcatcattaccacgataatcatcacaagacatattaacataaaaataattgttactaatgttctagccaaaattcacacctcctgccatctacacaaaatctaaattattatagcacagttttttccataaaacaagcttttaattcgactgtgttgtggattctgcagagtctgcagactgttctgctaaataatcctgtgtgctttccgtaattccatcaataaatgtatcaaaaatggatttcgactgtgtcatagactcctgtaaattaccatttttaatatattttttgtattttttaaagtttgtattgcttgttgctaatgtatccaatgaagatccatcaatcgtaaacttctctgtattaaatacttttgcatttccggctcttaagttcttctcaagttctgcagcctttgctgcagttccatccgttacatgctcatcatttaactgggaaataacgactgcatcttctgcataacccgctgtccagtctgctgcaatttcttttccatttaacaccttgttcactgcataagtataatacttactccagtcagatgtaacagaagtcagcgcatcttttggtgcagtagagatgaggttcacatcattaccgataagtggtgtatcattttctgcacaaacagtcgcaactgccgttgtatatgtgtactgcgccatcatctttacacctgctgcaataagctgtcttgccgccttaccatctgcatcataaacacctcttttgccgacataacggactaaaattgaagactgagaacaaactctttctaccccaagataaaatgcattgatgcagcttgttgtctttgctgttttatcataggccacaaaaccaatgacacactcagaagcactaatatctcctttgtctaaaagatgatttaatttcacacctgctacaagacctgctacatgatatgcttcataaattcttgtatcataattgtggaagtttgaaagaccacttttctttgcaagctttccaccttcctgacaaaactgtacatcaggatattttttcgcagcttcttctaaaatactttccaaattcggattttctgcaaaaataatgtcacagcctttttcgacaagctctgcggctttcttctcacaatctgcctttttcacactttctgcaataataatctggtcatcggcaatacctgtctcttcctgcattttgcggattccctgtacacgggcaacggtatcaggcgcatccccatcagaagataacagatatcctactttaatgcttccgctatctgctgtctttgtctgctgcttattccctgtattctcaggaaacaaagacttactgcttccgcatccgcagagggaaaatgccattaccaacgctataatcactgctatatgttttctcatgttttcaattcctccgtttctgtgcttaacggtcctccctgaagtaagccagtcccagactttctggtggctgctgctctttcttcttacgaagacttgtgataataagcacaataattgttaccagatatggaagcatcttgaagatttcctgcatacttcttccaagtcctggtatataaagatataaaatgtaaagtcccccgaaaagaaatgaaccccagattgcattgattggtttccaaagagcaaagataaccagtgctatcgcaagccatcctctgtcaccaaacccattatttgtccaggttcctccagaatattccattacaaaataaagacctccaagaccggcaattcctccgccgatcacagttgcaagatatttatacagtgtaacgttaattccggctgcatctgctgtcgcaggactttctcctacagcgtttaaattaagaccccaacgggttctctttaagaaaaacgccataagtagtgtaataataattgcaaaatatgtcaagaacccataattaaaaaatatgtccccgataaccggaatctttgacaacagtgggattttagcacgataagcatctccggtaattgctacagatatctgtccaacaccaccggcaagtgtagaaagagaaccaccaaagaagttaccaaatccaacaccaaatgttgtgagcgcaagccctgcaacattctggtttgctcttaatgtaattgtcagcacactgaaaatcagcccgccaaacgccgccatcaaaaatgcagcaaggagagaaagaatcattcccacaaggccatttggatgtgcggcaagtttttcataatagaaggctgccatcaatccggcaattcctcccatgtacatcattccaggaacaccaagatttaagtttcctgacttttccgtgagaatctctccgtctgcgccaaagagcatacaaattccctgcataaccgctttttgtataaaggtaattaatactgacatttcattctccctccttatgcgctgtgctttttacgaaattccagtttatagttaatgaaaaattcacatccgattacaaagaacaaaataattccggtaattacctctgatgcattttcattcaggttatactgtgttgcaatctggattgctccctgctgcataaatacgagaaggaatgcaatgactgccatcgcccacacattaaacttcgcaagccatgctacgataatcgcagtaaaaccacggccgcctgctgtacttgtagaaattgtgtgggaagaaccgcttacaagaataaatccggcaattccggcgattccgccagaaattccaactgtgcggacgatgacctttcctacgttaattcctgcataacgcgcggtattttcactctcacctacaacagcgatttcataaccgtgttttgttctcttcatgtagataaacattaatactgtcagtaataacactatagcaagattccatccataatcaaggccaaacagctgtggaagccagcctgctctcgttggcgcattaatgattccaacagaattagaacctgccgggttctcccagtatacaatgcaaaatgttacgacctgcattgcgacataatttaacatcagggtaaataatgtctcatttgtattccatcttgctttaaagaatgcaggaatgattccccagattcctccagcaataaaactacatacaaacataagtacaagcagtaagcctgttgggagggcattgcccgcataaatcatcatagccgcagaagcaacacaccccataaggatctgtccctctgcaccaatattccaaaacttcattttaaaggcaggagttaccgcaacagcaacacagagcaaagttaatgcatctcttgccgttacccagaaacgtctgcccgttcctaccgctccttctacaattccttcatagacctctactggattcattttaataattatgaaaataaaacctgcacatacaataagagaaagaagaatcgcaataattcttaccagccatttctttccaaatgacatatcctctctttttgaaagatgtatcagtggctctttcactgtattatccattattgttcctccttatgggatgtcatcaatcttcccacttcttcttttgttgtctttctcgcatctacgattcctgttaccttgccatcacaaagtaccatgattctgtcacaaaattccagaagcatatctaagtcctctgcgacacagacaactgaaactcctctttctttctgcttatttaacaagttataaatcatataggaagagttaatatcaagaccacgtactggataggctactaagagaaccgccggagaagatgcgatttctcttccgacaagaatcttttgtacgttacctccagaaagtcttcttactggatagtcaatatccggtgtcacaacatccaaatcttctttaatcttttcggcaagttccttcggtgcttttaagctggtaaagaagccttttccctttcgaaaagaacgaagcagcatatttcctgtcatacccatggagccgacaagtcccataccaagacggtcttccggaacaaatgaatggcggacaccaagttcattaatctgcgccgcatcatatttggcaaggtcaatatcttctccttctggtgagtggaaaatgacacttcctgatgaaagctttgtaagaccagcaatggcctctaataattctttctgtccactaccggaaataccggcaactccaagcacttccccgccaaatgcttcaaaggatacattctccaggacatgcagcccatcttcattcgtgcaagtaatgttattgattgtaagacgttttttcaagtcatgtggcattggacggttaatatcaagagaaactttttctcccaccatcatctctgtaagggattctaccgttgcctctgaagtctgcagcgttccaatatattttccctttctaagaatagcaacacggtcggataactctaatacttcattcagcttatgtgtgataataataattgctctgccatcatctctcatatttcttagaacttcaaacagtttatctacttcctgcggagtcagtaccgctgtcggctcgtcaagaattaaaatatttgctccgcggtagagcattttaacgatttctacggtctgtttttgtgatacagacattgtatatactttctgtgccggatcaagatcaaaaccgtatctatctacaagttcctgaatatctttgtgcacctttttcatatcaaggactgcatttccttttaagccaagaataatattttcggcagcagtcataacatcaatcaatttaaaatgctgatgaatcattccgattccaagatcaaaagaatcttttggagaacgaatggaaactgcctttccatctactaagatgtgaccctcatccgggaaataaattccagaaatcatattcattaatgtggtctttccacttccgttctctccaagcaatgaaagaatctctccccgctttactttgagattgattccatcatttgcgacaattttgccaaatcgttttgtgatattttttaattctatggcatatgtctgttccaactttacattcctccattatctgattttatgtactcaaaaaatatttttactcctgattccgtgagtacatgcatttgtttataggcaagtcaaaaaagactggctactttcttctttgatttaactgtaaacaaaaattctgttttattccatgactgaaaatcgggcagagccgccataatgaccgctctgcccttgtcattgattgtattgttaaattactttgtaatggagttaattccatcaatgataaatgtgaatgctggtgctgaaggcattccgctttctacatcagattcgtggaaatatccatctttgatataatcttttaattttgttgcgtccttgtcaccagattctacgagttcttcaagagtcttaccgccaactgtgaacttagaagtatcaaatacatgaagagttccatcttcgattcccttctgtgcttcttctactgcttcctttgttccctcagcaactgtcttatcgttaagctctgtgattgcatctgctccgtcttttacaccttttgcccaatctgtctcgatggccgttccatcaataacactctgaactgcatatgtgtaataaggaccccagttgattgttgcagaagtaagtgctgcatctggtgctgtaggaatcatatcaatgttatatcctacacaaggaaccttctttgcttcacaagctgtaggtgctcctgttgtatctgcatgctggctgataagtacgcagccatctgcgattaactgttctgcacattctttttcaaggtcaaaagatgcccagctatttgtatattttacttccattgtagcggaatcacaaacagattttactccaagatagaaagaagtaaatccactgataacctctgcatatgggaaagcccctacataaccgatcttacatttatcttttgaaacttcgccatttttaatcatctcatttaacttcataccagcaacaacaccggataaataacgggattcatagattctggtaaagaagttatgcatgttagaaagtccgctgctctttgcctgatatcctgttgcatgacagaactgtacgtccggataatctgctgcggcctgaagaatataactttcatgtccaaaactgtttgcaatgacgatgttacatccctgttctgctaagtcaactgctgcatcgtaacagccttcgtcttctttgatgtttgtcttgataactacctgatcatcagaaagtccaagattcttcttcatctcttctactgcttttaaatgtgcctcagtgtaaccttcattttcatcaccaatcatgatacatccaaccttaatatcggatgcggctactgcctctcctgctgccgaacttcctttcgctgatgtggaaccttctgctccgcctttggaagatccgcaggcacaaagtgatgctgtcattacagcggctaaaataaatgccagtaattttttcattttctttcctcctatatctattgcttatgaaaaaatacatttctatattagactacattttttcagaagtaaagtcgaaatagacagaaaataatttttttctcacaatttcttcattttttagcttttgtaatacaactttcgttctctttatttcctttttctctccctatctgccatagcttccattatttccaagttcttcttcaatccgcattaactgattatactttgcggtacgttctgcacggcacggtgcgcctgtcttaatctgtccggcatttactgctaccgccagatctgcaatggttgtatcttcggtatctccgctccgatgagaaataatcgtgcgatagccctctttctgtgccattaaaatcgcatctaatgtctctgataatgtgccaatctggtttggctttattaaaattgcattggcgattcccttctcaataccgtccgataatctctttacattagttacaaacaggtcatccccgacaagttgtactttctcacccagacggtaagtaagtactttccatccagcataatcttcttcactcagcccatcttcaatagaaattaatggaaactgttctacaagttcttcataatactgcaccatttcttctgcattcctgcaaatttctttttcccgcatccggctttctcccggaaaataataccgctttgtattttcatcatataattcagaagccgccgcatccatcgcgaaaaagatatcttctcctggctcatatccggcaagtgttgttgcctcctgcaaaatttccaatgccgcctgtgcggaatctaaatctggagcaaatccaccttcatcccccacaccggtagagtaacctttttcagaaagtgtcttttttaactgctgataaatttccgcacacatctgaattccttcggaaaatgtttctgctcctgccggcataatcataaattcctgaaaatcaattgaatttttcgcatgacatccgccgttaatgacattcatcatcggcaccggcaatactttgccgtttactccgccaacatagcggtaaagcgggagaccaagcccatctgctgccgctctcgctacagctagagaaacacctaaaatagcattagcaccatatcgactcttattctctgtgccgtctgcctcccttaaaatacggtcaatttccctctgttctaaggcattacagccacatagacggtcacagattcttgtatttacgttggtgacggcgcgctccacgcctttccctccgaaacgcttttcctcatcccgaagctcaactgcctcaaaacgtcctgtcgaggctcccgatggcacaatagcctttcccatcgcaccgctttctaatcgcactgtaacctctaccgtaggatttcctctcgaatctaacacttcgagtccatgtacatcttcaatattaaaaccttttttcataaaaaaattcctccttactgaatcttgaaaatatttcctttcttcagtatgggaggaatttgtttttttatacatggaaattaagcatactgttcaatatatgcttttacaactgccacaagcttttcatagctcatgcttgcagtatttaaacagaaatcatagtttctggaatcattccagtccttaccagtatgatatttataatagtctgaacgatatttatctgtcttttcaatcttgcggataatatccttctctttaccgccgttttgtgtctttacacgggtaatacagtcttctcttggggcatagaaaaataagcggattacgttcggattatcttttaagataaagtctgcacatcgtccgataataacacaagattcttctgctgccacttctttaattaccttggcctgatagttaaaaagattatcgtcagatacaaagtcatcgctttccggcgggaatacttcacccttgtaaatcttcttactgataccaaacagcggaagagacttcaccttctcgtctacctctccaaacaaagcttcattgatgccgctctgctcggaagccatacggagcagttccctgtcataacagtgaataccgagttcctttgctaaaagcttgcctaaagttcttccaccgcttccataacttcttgcaatcgtaattactgtatgtttcattgtaacacctactctcccaaatatgcctttttaatagactcattattcataagttcttttgcatccccgctaagagcaatctttcctgtttctaaaacatatgctctgtctgcaattgccaatgcctttttcgcattctgctctacaagaaggacggttgttccctccgcagaaatcttctgaataatcttaaaaatctcatctacaaaaattggggacagacccatagaaggctcatccattaaaacaattcttggtttggacattaacgctctacccatggcgagcatctgctgttctccaccactaagagttccggcggactgatttcttctctcttttaaacgagggaagctttcatataccatttcaagagactgtgcgatctcgttcttatcttttcttgtgtatgcgcctaacttcaggttctcatatacagaaaggttggcaaatacacgtcttccttccggcacatgagccattcccattgttacgattttatgtcctggtacttttgtaatatcctgtccttcaaacagaatatgtcccttctttgcctgaagcataccggtgatcgtctgaagagttgttgtctttccggcaccgttcgcaccgataagagcgataacttctccctgatttacctcaaaggaaatccctttgatggcctgaatcatcccataatatacttcaaggtcttttacttcaagcattgccataaagttctttcctcctattctccaagatatgccttgataacttccggattatttaaaacatcttttgtcttaccctgtgcaagtacctgaccaaagtttaatacggtaagttcctcacagattcctgaaaccagtttcatatcatgttcaattaataatactgtcatatcaaaattatcacgaacgaaacggatagtatccataagctcgattgtctcatttgggttcataccagccgcaggctcatctaacagaagaagctttggatttgtcgcgagtgctctggcgatctctaacttacgctgttctccatatggaagattcgatgcaagaaaatctgccttatcatcaagttcaaatacttttaaaagctccattgccttctcgttcatttttctttccatcttgcggtactttggcaaacgtaaaatacctgtcaaagtggaatatttgtattgattatgcaatccaatctttacattatcaagaacggactgctgagaaaacagacggatattttggaatgttctcgcaatacctgctttgttaatctcaatcgttttctttccaactaagtcttctccatctaacttgatgataccatctgttggtttatatacaccagtcagcatattaaatatagttgtctttccggcaccgtttgggccaatgagaccgtaaagctggccttttttaatgttaatttcaaactgatctacggcacgaaggccaccaaaagagatacctaaattctttacttcaagtaatgccatctttactgtacctcctctgctttttcttttttgccaaacattctcttaagggagtgtttctctctccactcaattgcctttggtgcccagttaaagagcatcatgataattaatacaatagcgtagatcaacatacggtaatcagcaagtccacgaagaacttccggaagcattgtaagaacaacggccgcgataatagaaccacggaaacttcccattccacctaagacaacgaatacaagaatcatgatggacatgttgtaaccaaagtttgcaggaagggctgttaatgtagaaagattgtgtgcataaagaacaccacctgcaccagcaatagctgcagaaatagtaaatgccatcagtttatactttgtaatattaatacctacagactctgccgcgatacgattatcacgaattgccataatcgcacgtcctgttcttgaattcacaaggttaaaggacacaaaaaggctgattaaaataataataatacccacgacaaaggtagactggtttggtgtaccaacgataccttttgctccgtcaataatcatttttccatctgcctgcatatttaaagatgcactatccttaatggaaaaatggaatcccttgctgtctcttccaagatacataacgttaattacgttcttgatgatctcgccgaatgccagtgttacgatagcaaggtagtcaccgcgaaggcgaagaaccggaataccgattaaccatccaaataccgctgcaacaacggtaccaataagaagtgctaaaataaaacgaagtgtctcgttcattcctgaagtcatcatgcatttggaaaataccgcactggagaatgcaccaacacacataaatcctgcatgaccaagactcagctcaccaagatatcctacacaaagattcagtccgattgctacgatagaataaatacaaagcggaactaaaagaccctgcatcagactcgacatcattcctgtagatatcataatctctacaataataaatactgcgattaccatagcgtaggtaatcaacatactttttgtctgtttgtttatacttttcatatttgatttcttcatttcttacgccacctacactttctcctgaacctgcttgccaagaagtcccgtaggttttactaaaagtacgataatcaatacggcaaatacgattgcatcggataactgagaagaaatatatgctcttcctaaaatctcgattactcccaataaaataccaccaattaatgctccaggaatagagccgataccaccaaataccgctgcggtaaacgccttaataccaggcatcgcacccgtgtaaggagacagggttgggtaagcggaacataataacacacctgcaatagctgctaatccggaaccgatagcaaatgtaagggaaattgtcttgtttacattcacacccatgagctgtgctgcgtctttatcttcagatacggcaagcattgcctgaccggatttagactttttaataaaaatcattaacgctgccatgataataatacaactgataacagttgcgattgttacaccagaaattgtaaggtctccacctgcaagcttaattgtagggatacttacaaccgatgtaaaggactttgtatctgcaccaaataaaattaatgcgaagttctgcagaaaatagctgacaccgattgctgtgattaatacggcaagcggagaagcctttctcaatggtttgtacgcaattttctcgataactacaccaagtactgtacagccgattaccgctgcaataatacttacggtagagtttaaatgaaagctgcccattaaaacgaaaacgatatagcagccaatcatgataacatcgccgtgagcgaagttcagcatcttagcgataccgtataccatcgtgtagccaagggcaataattgcataaatactacccagactgacaccattgatcaaataggatataaaactcatctttacctccatgccgcttatgcggcgtttctagaaactttaaaaagttgatgtcttttttatatcacagagaaatcagctcgtaatctttctgtgatataaaaaaggagataacctaatacaaaaaagggttacccgcaggtaacccttccctgggctatatattatttaaattacattgctttgtaagcaccgttcttaataataacagccttaggagacttagttacttctccgctttcattccatgtaagaccgtcttctccacctgtgagaccctgcatcttaatcttagtcatagcaccttttaatgcatcacacatatcagaagcactcatatctgtagttgctttagattcctcgattgctgcctttaatgcgtaaacagcatcgtatgagtctgctgcgaactggttaggagtatctttatatttttctttgtaagtctttacaaagttctgaactgacttatttttcgcatctgctgcgaatggagttaagagcatgacatcttctgctaacttagtatcaaagttctctactgtaaggataccatccattccgtctacaccaaagaatttaggtttgtatcccatagtgtctgcctgttttaaaataatagatgcttcctgatagtagataggtaagaacaataagtctgctcctgcatcttttgctttctgaagctgtgttccaaagtctgtcttggaatctgctgtaaatgctgccttagaaacgatgttaagcccctgtgtcttagcttctgcttcaaatttttcttcaatacctgaagaatatacatcagaactatcatagataataccaatcttagttggaagcttgttctctgcaatgtactgagcagaagcaacaccctggttagggtctgtgaaacatacctggaatacatttccgtttccgctggaaagtacatctggtgaagaagcagatggtgtaatctggaatacattatcggatgctgtcttaccagctactgcgatacatggagcagttgttgttgttccaactaacatctgcataccccagtcttttaatgtattgtaagcattaactgctttctctgcatcgttctggtcatcttcaaaacggtattcaatctgcttaccgttaataccacctgcagcattgatttcatctactgcaatctgtgctccgttctttacggctgttccgtaaatcgctgttgctccggtagtcggtccaataccaccaatataatatttgtctgcatctttcttagatgaagaacttgaattgctaccacatcctgttaatgctgttactgccattgcagcgactaacattacgcttataaactttctcattattttttcctccttgatagtttataacgaaaaaatatcttttggaacactgactcactcatgaataagttgattctgcacagccatatcaatatgtcagcccaccagataatttcatgaactctatattactacactaaaatcataaaagcaagattttttgtacgaataaaaaaatttttgcaactttttttgaatttggcttcatttttatgtttttttagcatgaaggattgtataaaaccctttaatttattagtctggcttcccactcaaatctcacaaaaaacgtgccagcctctctagagcgtgtttatataagcaatttaagcatatcaaatgttatttatacaacaaacctgcgataaagtaactccttttattaaaaaatatactttatcctcctactttgcacataaattttcagacaattcttattttgacggaaaatccatctttccattcaaataatttaacacaatacatcagaatatataaagccagaaggcagagaataaaataatctatatttgtggtctcggagcaagtgttggatacgagcccaggagcgagtattcaacacgccgtaactaaaaccacaaatatagattattttattctctgctttcgtctgtctcttagagcgtgtttgaaaaacgctctagtgagataaaatctccgttccatcctctgtcactaaaatcgtgtactcccactgagcagacggcttaccatcttctgtgcggattgtccagccgtcatcttcatcttcccatacgtctggttttcccatatttaccatcggctcaatcgtaaatgtcatacctggtacaaaaaggattccctcatccggctgcccaatatgattaacccacggttcttcatggaattgcacgccacagccatgtccgccgatttctcttacgacactgtatccattctcaacagcatgtttgttacaaacataccccatatcacccatggttccccacggttttgttgctgcaagagcaaggtcaacacattcttttgtcacgcggacaagtttcttcttctcttcagaaacgtcaccgatacagaacattcttgatgcatcaccaaaatagccattataaattgtagtacagtctacattaagaatctgaccactctttaaaatctggtcatcacttggaataccatgacatacaacatcatcaatagaaatacaaacactctttggatacccctgataaccaagacaagctgggattccaccgatttctcttgtatattcttcgataagacgattgagttctcctgtacttactccctcttttacatatggagtgataaagtcaagaaccattgtattcttcttaccagcttcacggattccttctatctgctctggtgtcttaatcatagaatggtctggtacttcatatcctctgttccagtaatctttgatacggttatcaaaagacatatgacatgctttatatttctttccgctgccacaccagcatttatcatttcttcctattttcattattaaatccttctttctgtaacgttcctctaatttatatttaaggcagtaattttttatttgtaactttcggaaatctactgtttcctgacaagcgcttaaactatatataagtattttactgtataaatatcacgcttacttaaataaacatatcacacaataaccaattgcttgttatatcactgccaacatatcgtatattaagccacttaagctttttttgcaatatatttttcttttctaatatttattttgtatgccaatctacatctcttcgcatctgttctgtcatacatattattgcctaaatgcactttctatatctgtccaaatcaccattcatatctattttggataaatacagattttcgcattcttatctacggtctgcataatctttttcatatatttctgtttcacagccacgcagccacctgtgtatggattgcttcctgtgcagtgtaagaaaatagcagagcctttcttataaacacagtttttattatagtcaatcgctagtgcataattataatgtggcttataatcaatcagatgctctccagagcggcttgctttcaccttacggatatcaatcatctgattataatatctcctatccccgctccaataatggtatttattcagctttatgtattttatcttactgcgtggattcttcttaattccgaaagcctttgtaaaactataagtaccagttggcgttttcttatctccctcacgtttcttaccaataccatttttaccgacataaccgatacagccaaatacttttttaaactttccatttactttttcatacaaaacgatatttgccttgcttttacctttgtattttacgaagataagctggtttacttttttgcttttttcatatttttggagaagcgttgtccatttgtcctttttgactttggatctattagctactgttgtgctctggctttttgcagtcgctgcttgtaggggaatcgcgttatctgccgctataaatatgcttataacaaaaataatgcttaaaaagatggctaatccgttcaaataacaactgccttttttggtattttctttcataatacgtgcttcctttcttttttattcttatacttaatttagcaaatttattataacataaaaaaagcaatcaaaatatttacgattgtttttttgattgtttttaaatgaaaaaaagaccttgcaaatctgatttttcacaaatctacaaggtctattttgtttatttttttattggacgctaatcatctctgcccttttcaggataacgatatttgtccccacaaatacagcctgcttatttcttgataagaagtgattttcctgtcatttctgctggctgttccattcccatcatctcgattaaggttggagcgatgtctgctaaacatccgccttctcttaatgtgtaagccgggtcgtaatttacaaggataaatggaactggatttgttgtatgagctgtgtatggttcacctgtttcatagtcaattaactgctcgcagtttccgtggtctgcacagataaacatctgtccatctacttcttttaatgctgctacagcattgccaacgcaggtatctacagtttctactgccttaattgctgcttcctgtactccggtatggcctaccatatcagggtttgcgaagttgatgatgatgacatcatatttgtcagatttgattgcttctacaagtttttctccaacttctggagcgctcatctctggctgtaagtcataagttgctactgctggagacttaacaaggattctgtcttcgcccttattaggaacttctacaccaccgttgaagaagaatgttacatgagcatatttctctgtctctgcaagacgaagctgtgttaagccgtttgctgcaagaaattctccaaatgtgtttgtgatttcttctttgtggaatgcgatgattttcccagggattgtctcatcatattctgtgaagcagacataagttaatggaaatacgccatttcttctctcaaatcctgtaaattcagggtcacacattgcacgagtgatttctcttgcacggtctggacggaagttgaagaagataacggaatcgtttgcttttactgtgcctactggctgtccgtctttcttgattactgtagggataacgaactcatctgtcttatcattatcataagaagcctgaattgcctctactgcatctgctgcttcattaccttcaccgtaaactaaagcagcgtaagctttttctacacgatcccaacggttatctctgtccattgcatagtaacgaccttcgatagatgcgatctggcctacaccgatttctttgatttttgtttctaattcttcgataaattctttaccagatgttggagctgtgtcacggccatctaagaaacagtgcacgcatacgtctgtaagcccctgtctctttgcaagctctaataaagcgtaaagatgtgtgttgtggctgtgtacaccaccatcggataataatccgtataaatgaagggtagagttattctttttacaattctctactgcttctaaaaatgctttattatcaaagaagtctccatccttaattgctttcgtgattcttgtaagctcctgatatacgatacgtccagcacccatgttaaggtgtccaacttcagagttacccatctgtccgtctggaagtcctacggcaagaccgctggcatttccttttacaaatggacatttttccattaatttatcgatatttggagtgtttgcctcatatacagcattggcttcatgtctgtcatttaaaccaaagccatccataattaataatactgtaggttttttactcattttataatctcccgtttaaagtgtatactaactctataaaataatacaaaaataatcatatattgctattgatataatcctgcaacattttataggattggtatagttgacccgcggagaaatgtccgcgggttactattttcgtgattcaaatatggaatctattatttattgtagtttacgatctgaccaaaatcagcctttaaggaagctccgccaacaagtccgccgtcaatatctgcctgagcaaataagtctggagctgtcttagcgtttacgcttccgccgtactgaatacggattgcagctgctgttgcatcatcatagatttcagcgatacatttacgaatctctgcacaaacttcctgagcctgctctgttgtagcagtctttcctgttccgattgcccagattggctcgtaagcgataactgctgtcttagcctgatctgctgttacatttaagaaaccaactttaacctgctgacggataaagtccattgtaacaccctgttctctctgctctaatgtttctccacagcacatgattggtgtgataccatgttcgaaagcttttaacatcttcttgttaactgtttcatttgtctctgcgaagtattctcttctttcagaatgtccgagaacaacgtattttactccagcatctactaacatagcaggagaaatctcaccagtgtaagcaccgctctcttcatagtacatattctctgcaccaattgcaatgttagaaccttttgcagcttccatagctgggataatgtcgattgctggtacgcagaatactacgtcaacatcttcattcgcacaaagtggttttaacatatttactaattcaactgcctcactaggagttttattcattttccagttacctgctacaattttcttacgcataacaaattcccctttattatatatttatgatgttagggtcaaaaggtattctgaccctaactgatgtcacgaattactctgtagctaacgctactcccgtaattctgaaattatttatcgtttgctgctgcaacacctggtaattctttaccttctaagaactcaagagaagctccgccacctgtagaaatgtggctcatcttgtcaccatatccaagctggttaactgctgctgcggaatctccgccaccaatgattgttgtagcatctgtctcagcaagtgctgctgcaactgcctttgttcctgctgcaagaattgggttttcgaatacacccataggtccattccaaacaactgtcttagctgtctttactgcctctgcgtataattcgattgtcttaggtccgatatcgcaagcttctttgtctgctgccatagcgtctgcatcgtatacatatgttgggatttcagcatcgattgggttagggaaagcatctaccattacagagtcaactggaagaagtaacttcttgccaaggctttctgctttttccatcatttctttacagtaatcaatctttgtctcgtcaactaaagagttaccgatttcatatccttttgcttttaagaatgtgtaagccataccaccaccgatgatgagtgtgtcacacttctcaagtaagttagagataacgtttaacttatctgcaacttttgctccaccaaggatagcaacgaaaggacgtactgggttctctacagcattgcctaagaaatcgatttctttctgcattaagtatccaactactgctgtgtctactaaagaagcaacacctacgttagagcagtgagctctgtgagctgtaccgaatgcatcatttacgaatacatcacagatagaagcaaggtctttggagaattcttctccacactttgtctcttctttgcggaaacgagtgttctcaagtaagataacatctccgtctttcatagcttctactgcagcttttgcgtttggtccaacaacttcacggtctgctgcaaattttacttcctgtccaagaagctcagataaacgagctgctactggagctaaagtctttgttgtgtaatcttcttctgtttttactttacctaagtgagagcaaagaattactttaccgccgtctgcgattaacttcttgattgttggaagtgcagctacaagacggttctcgtctgtgatcttaccatcttttaatggaacgttgaagtcacatctgcaaagaactttaagtccttttacattaatatcgtctacagattttttatttaaacccatgttggaattcctcctaaattatattcaatgtagtctgaagaataaacttgattgcaagacagaactgtcatgcttctacaaagaaatcctcaaatacattattcaaaaaacaaacaaaggcccggtcccacgagaccggacccatgtttgagtcttatattcttaaatatatactaatactatcgcttaaattatgctaattctgcaaagtatttgattgtacgaaccatctgagatgtgtagctgttttcgttatcgtaccatgaaacaacctgtacttcgtataaatcatctgcaactttgttaaccattgtctgagttgcatcgaataaagaaccaaatctcattcctacgatatcagaagaaacgatttcatcttcgttgtaaccgaaagattcgttagctgctgctttcatagctgcattgattccttcaactgttacgtcagcacctttaacaactgctgttaagattgttgtagatcctgtaggtgttggaacacgctgagcagatccgattaacttaccgtttaattctgggataacaagaccgattgccttagcagcacctgtgctgttaggaacgatgttaactgctgctgcacgagatcttcttaagtcacctttacgctgtggtccgtcaagagtcatctggtcacctgtgtaagcgtgaattgtacacatgataccactctggattggagcgtatttgttaagagcgtcagccataggagctaaacagtttgttgtacaagaagctgcagagataattgtatcttctggttttaatactgtatggtttgtattgtaaacaactgttggaaggtcgtttccagcaggagcggaaataacaactttcttagcaccagcattgatatgagcctgagctttttctttgcttgtgtagaatccagaacactcaagaactacgtcaacaccgatttctccccatgggcaattgtttgcatctgggaaagcgtagattttgatttcctgtccgtcaactgtgatggaatcttctccagcttttactgtagctgctttctcatatgttccctgagaagagtcatattttaataagtgcgcaagcatcttagggcttgttaaatcgttgatagctactacttcatagccttctgcaccaaacatctgtctgaaagctaaacgaccgatacggccaaatccattaattgcaacttttactgccatggtaattcctcctaagttttagatatttctttgacattaaagttcgcaggaaatatgccctcctgcgctgtgatttgactttccctgtcaaatccttaactattttacctaattattgccaagatttcaagtagtattttgcataaaattatagattttttttcatcacttttatgctattatgatattgttgccatttttcctgcaagtatacagaacttttggccttaaattacaattttttacccttattttaaatgtgcaggaaaatacaaatgcaaatttttaccagaaaggaaacacggttatgatttacacagacacacatcttcactcctctttttcttccgattcagacacaccgatggaactgatgatcaaacagggcatccgtctcggaatgaaaacgttgtgctttaccgaacattacgatccctgctatccggacactcctgatggtctggacttccttttagattttgaaaattataaaaagactctttttactctcaaggaaaagtatgcctcacaaatcgagattttatacggacttgaactcggtgtgcagccgcatcttgggcagacactcgctaacttttataaaaaatatggcaatgattttgattttatcatcaattcctgccatatcgtaaatggaacggatccttattatggaacttattttaaggaaatgggtgcaacccgcgggcttatgaactactttgaaacgattcttgcaaatttaaaagtttttccacactatcagtctgtcggtcatcttgattatgtctgccgctacctgccagagtcttcacagacattcttttatgaccattttacagatgttcttgatgaaattcttattgaaatcattgagaggaatcgtgctcttgaggtaaacacggcaggtcttaagtatggacttgactggccaaatcccgatatttctattttgagaagataccgggagcttggcggggaacttatcacgattggaagtgatgcacatcagccggagcatatggcgtgggagtttgatcatgtgcctgctattctccatagggctggtttccatcattatgtagtgtttaaggggaagaaaccggtgttttatgatatttaaatgctgacgcaactaaaaaaggatataaccagcagctgttctatagtcgctggttatatccttttttagttgttgactttgaatatcataaagtattgtttcttctcaaataatctcttaaaacaaatccagcatattatcaagatatattgcttctctgatatgtatctgatattctggcttaaccatataataaagcaggaattccagcaccaatgcactgccaagtccccgtccttcaattttgaaattcgaaaatcccattggcagatagctgttttggatatcctctatcccgataaatcctgaattcttcattgcttttgaaaagcggtatccttgttccgcattcggcgcagtacagtgatgttccgggtagtgctctcccagattcttcctgctcactgcctcatagcagcgttttctatccttacagccaaaccagcagcattcattacataggaattccactttgtctttttctatttgcgttaaggtatttaacctatcaaaagacttgttcaaacgaaaatctgggacaacgtattgaaaatcttctctttttacttcttttaaaaagtcctgaaaatttgtcaggacttttgttgttgatgagacaaagtaaaggttaggatagttcttttttaaatattctaataacaggtccgaatgaatgataactccattttgtatatccccagtttcttcaaacaatctgcaaagcgcattacattttttatccaaaagatgttcttctctaagcagagaattactaaaagtcagccgggcagaaatcccataccctttcattaaatctaacactttctttgcatcgtcatccccaaatcctgctcgtcctccgccccagatacaatccgctggggcaccatagacagatccaatatcgcaccaatcataaaaatattctccatgttcccgaaataacggcaaaaacactttatacaattcataaaactcaaacagccccggaagatgatactgtgctatacttcttttcacttatagtgcctccttattctatccgaagcatccggtatccgattccgatatgcgtctgtatatactggagtccatttttatctggttcaagtttttttcgtaatgttgccataaacacccttagtgaagcaatatcattttgtgaacaattcccccatatctgctgtgtgatataggtatgcgttaatacccttccgacattacgtgacaaaagacataaaagcttatattcaattggtgtcagatgcagttcttttcctttcagataggtacagccagctgtataatctattttcaattgtccgttaataaaaatagaagcttcctgttcttctcccgcctgaataatggcaaggcgccgctgtgtcacccgtatgcgggcaagcagttcttccaccgaaaaaggttttgtaatataatcatctgccccggaatctaatgcttctattttatcgctgtcttcacttcgagcgctgataacaataatcggcatattggaccatgtacggatttttttaattacatctactccttccatatccggaagacccagatctaagaggacaatatctggatgatgtgaagatgcttccattatcgcagatgctccatttttagccgtaagatatttataatcatgcatttttaatgttgttacgatgagatttcgtatcggacggtcatcctccacaacaagaactactgttttattcatttaatgtcacctcgctaagtggtaaagtaaaagtaaaaatacatcctcgtggtgtattatctgtaagaaggagccttccatcatgtgcttctataatagattggcaaagtgacagacccagaccgagacttctctggctgtctgcaatcgtacttttcccagtataaaacatctcaaagatatatggcttcatttcatctgcaatacccggtccattatcctccacacagatctgtgcttttccattacatttcattccccggatacagattttcgaacctttcggtgtatattttatggcattatcaatgagattcactagtacctgtatgataagctgcacatccattcggacaagaatcagttcttcacactttgtcacaattgtatattcatcatgcttcctgctgatatgacgcaaagattctgcaatgacttcatcaagtaactgatctgtaaatttaaacttcagtcgcccatcattaagccttgtaatagataacagattctctaccacgccaatgagccattcagaatcatcataaatatccacataaatctgctgcttcgttttactgtccaggcacgctccgttatttaaaagcatatccgcattgccggaaatagaacaaagcggcgtccttagatcatgagaaatcgcacgcagtaaatctgctcgcagctgttcatttttcgccaaaacagcattcttctctttttctattgcattgcgcagattttccatagcaagcgcacattcatttactacggaaagtaaaatgctatactcaacggaatcaaaaacatctttgttcgccgggattccaattacaccatatacgtgatcaccaatgcggattgctaaatataaacattttgcatttttaaaataattcgttcctactcctgcacgcttattattttcatagacccatctggcaatcttttgttcttccggtattaaaaattgctgatctgtttcttctttgtttttataaaatacctgtccctgtgacaatttcccctcttctacaatatatgcaacaatatcccggttcagtaaacgaaccaactgcgtgcaggtgacacgtagcatctctttactgctcctcgctttttgcagcaggcggtctgtgtcgaataatacctgcgttcgaaatgcgagctgagagtaaatccttgcatgcatttttaatttagcggaaagagttcccgccaacacagagcataccagcataatcgcaaaagttaccggatatccaactgcatatgtctggaaagacatcctcggttccgtaagaaaaaagcaaaataaaacaacgcttaaaaaggaacctgcgatactgcacagataaccgtctgtcaaaatagaagtaatcaatacaccaaggatataaatcgtaacgatattcgtatctgtaaaatgcagtttctgaaataaaagaccaataatagtacatatcataaatataaaaaccgtcacaaaacaatctttcattgacggtttctttacatataatgcaaaatgctgctttaatacgccttctcttctttcattttcttccattattttaatttcccgccttttacttgaattcaagagtatattagagtatatcatactgctttatcaccgtcaaaacactgcctcttatctttcttttttgaatcataaattatcatacctgctttaccacattttttttgataatcatgtatttcttttaacaactcttcatcagaaattttatccaaagatataattttacaggattgcgtattttccctctcctctataataaatgctttgtaattttcattgatgaaatatccaatctttcccataacaaaaaaacaaacaataaacattaccaatactgttaagagtaaaattacttctttcatcatttatcccctctttaatttaaatatggaaacactttttaattgccttatgctctccgattactaaaagagagatatttcctgtaaaaaatgtatctggagatattgccatgctaagctctccattattttttattgccaggatattaatatcatattttcttcgaatatccagctctccaaccgtttttccaatccactctttcggtacttccacttcaaatattgcatgggaagcatctacttccatataatcaaggatatggtcatcggtataacggattgaagcccattttgccacctgtttttctggataaatcactttatctgcaccatttcttaaaaggaacttctcctgaacatccctctctgctctcgaaataaccatttttgcaccaagttcctttaatagagatgtggtctctaatgaattttgaaagctccctccaatcgtaacaaaacagatatcataatttccaattcctaatgattctaaaaattccgcattcgtgctatctccaatctgtgcatttgtaacgtagggaaggactttatctactctgccctcattgacatctaccgccataatttcatgccctaattcactaagctccattgcaatatgtcttccaaatctcccaagtccgattaataatatatttttcataattcgattctccctctgtgttatttaacggataccatacacgatcctaacacttatcctactgttaatttttctaatggcaaccttgcatttcccttctttttctttgaaaggaccgcataaataagagtaagtcctcctactcttccaagatacatgagtatgatcagtatgaattgtgatactatgtgaagctttggtgtgattcctaatgtaagccctactgttccaaccgccgatgctgcttcataaagacattccgaaagtggaagcccttcatatacactgatcgtaattcctccacataaaaataacatacagtacatcattgcaatcgttgatgcattctttatcacactccactcgattcttcttccaaatgtttcgacattttcctgactccggaatgtggcaaatgcattcaatataagcactgcaaaagttgttgtcttcatacctcctgccgtagaacttggcgaacctccgacaagcataagtataataatcattgcttttgaaacttctgtcattttagaaatatccatagtattaaatccggcagttcttggagttactgcctgaaaagccgatgcaagcagacgttttcccactgacagatgagtaaaatcagaaaaaaagaaaaaaacagctggtaaaactatcaaaagtgcggttgtcacaagtataatcttactctgcatatgatactttctaaagtgggttttattaatacaaatatcctcccacgtaagaaatcctataccacctgctataattaaaaacataatcactacatttacaatcggatttcctgcataagcggtaatggatggaaatggattcgctggcgtacctaaaatatcaaatccagcattacaaaaagctgatatggaatgaaacactgccatccagattccttttcttccaaaatcatgataaaaaaccggcagcaacgctaatgctcctgccatctcaataaataatgtcccctttaaaataaactttgtcagacggacaatgcctcctactttatgcgcagaaattgcattctgcatcgtgctgcgctgcatcagagaaatctttctgcctgacagcataaatacagaaacggcaacagtaactacaccaagtcctcctatctgtatcaaaagtaaaataactacctgcccaaaaacagaccagtaacttcctgtatccaagacagcaagtcccgttacacatactgcggaagttgatgtaaaaagcgtctgattaaatggagttatcactccttcggcagaagaaactggcagcattaatataattgcccctagcaaaataacacttgcaaatcccagaataattaattgaaaagaagacaaatgcttctttttatgtatgtcctttgacataaatccctcctgtgtattaatatttcatccggcatgtttccctcattatatatgtacccattcaaagatagtgtaaatatatcagccaccatattaagattacataaagattttttcgttctggatctctttggaagctgtttgttggctgcccatgcaaattcaggatttattttgagaaagatttccgggctttatccattcgccttataacttttttgctttctttagcatttttaccgcaaatcggggcgtgcagattgtagaaatggtttttcaagcacgctccagttaacagaaaaaagtagtaaccataaataactatacgattatggcaccgcttcaagtgtcaatcctataaaattttatttcccggaacttctacatctcctgtcctcttccccaaatccctccaactgattttctgagccgacaacgagcagaactcctgaagataaataaagcatatttgtggcctcggagcaaggtttggatacgagcgtgtataagcgagtattcaaaccgccgcgactaaagtcacaaatatgctttatttatcttcaggagttcgtctgctccgcagcctcacaaatcagaatttaaagttttcttctttttatcacaataccgattccgattgcaagtattaccagtggtattacaaatactgtcataatcaatgttgctttctgattaaatgccggtacgactgcattctctgtcttaaggctctttgctctgatagaaatcttgttcttttgttctgcaagatagttcacaccattcaatacaaagtctgtgtttgcaccacttactgcctggtcgatatcctgcagtaacatattggtacatccagttacaatcattcttccaccagtagaatctgatacagctacggaaatattaaatgggccgctgatatcattcttttctttattcagtgtggcactatctgtattgactttggagtatgcaccatcgcttgtggaaagcaatgaagttactgtataatcagatgcagaagaattcttctttgcattcttttctgtaatatccttcagtccctttgcacttggagctaaaatataaatattgctgttgtattgtgctgaggttgcatcagaactttcgatagttggaagcagataaattggatactgtgtatatttacttgcatctgtttctacaacgactcctttttgtggctctacattataagacttaagcaagctgtataagtttgtaagattctctacttttgcatctaaaaatacatacatctttccgccgtttttcatgtattttttaatcatcttaagctcatcttttgtaatgtctttttgtgcgccattgatgagtaagatagaacagtcatccggtactctctgctcagtaagaaggttcaacgtttttacagaatagttatctccttcaaagctacttgtcacgcttgtgtcaaagctctgttcagaatgtccacttaaggtatagattaccggtgtggagtcagagacaacgtagttgattgcttctgtcgtaaggctctctagctgaagagaatctgcagaataggaatagtcacttccatagctgtatgatacatagtcattagcagaaacataacgatatttcttaccacattttataatcatactatcattggctacttcttcactgctgtctgtatatttctttgtaaagtttggatacaaatccgggtctttataaacaaattttactttagtagaatttttcttatattctttccaaacctgtgcgtaggaagaatttacgctagattccttatcaataacgtaaatcgtgacttctttatctaaaccctttaagattttcttcgtctgtttggaaagagaatagattttgttggctgtcacatcgactgtgtagtttttacttgtcacaaatatattcactgcgataaccgctgcaatcagaacgacaactgccactgcggaaaaaatacctttttttaattttgtattcattttattcttaatcattgtatgccctcctaattccatctgcgcttttcaattccctgcatcgtaaggaataaaaataccgcgataaatgatacataatatatgatagaagatgcatttaaaattccactgcaaaaatcgttaaaacggtctaatacagaaaaccagtcgataatcttagaaagaccattatcaaacaatgcaggttttactttacttaaaatggcaatgatcgcgattcctgcaacaccaactccggctgtaatttttacattctttgtttcatcatagaaaaaccatgcgataagaataacagcaagtacgcatacaatgtaagtatatcttgctcttcccggtacaacatttgaaatattaggaagcaacatacaaaagagcactactgcaaaagataatgccgctgcgatcatctggttatcagtaagagaggagacaaacattccgaccgccatcaggcaggctcctaataagaaatatccaagacagcctgtaagaacggtcttccagtttacgtttccaaacatacttaacacacctgcctctatgatgcttactaacatagaaatagcaagtaatgttacggatgcaagatactttccaaatacaatactgccagagcgaattggggaagtatataagagctgatctgttctctgcttcttttcttctgcaaataaacgcatcgtaagaattggtacaatcacgatatataaaatcgtactgttagaaaatacatactgtgcgtaatcggtataaccataagacatacagattacagaaaaatacactcctgttgcagcgataaaaagagcaaaataaatataagctgccagtgagtggaaatagcttctcatttcttttaaataaatggctttcattctacttatcctcctctgctgtttctgcctgttcagttcccttgctgtctgcttttttcttccttttaaaagaaaatccatgatgtccctgtttctcaatctgttcggatgctttctttgcttcagattctacctcttctacatcctgtccggtaagtttcaggaatacatcttcaagagacaagctttcacgttccatcttaataataggtaatttctcttccgcaaactcaaagaacagattatcgcggatatcttcttttgtcgctgtttttgcctgtacatcaacgattccatctttttcatcgataatcttataatctctgatatattctgatacttttaatacctcttctacctgctcacggcttccctttacagacatattaatattatcggtatcggagaaatcttctgatagatgttctggtgtatcctctgcaactaacgttcccttatctataataagtacatagtcacatatcgcattcacttctgataaaatgtgagaacttaaaataatcgtatgcttctggcctaaacttttaataagagcacgaatctcaataatctgatttggatcaagacctaccgtcggctcatccagaattaacagcggtggatttccaattaaagcctgtgccagtccaactctttgcttatatcctttcgaaagattctttattaatcttcccttcatgtcagaaatctttactgcctctgttacttcattaatagaagattctttctctgtctttttacggattccttttaaatcacagataaagttcaaatattccgctacagtcatatcctcatacagtggtgggatttctggaagataaccgattaacttctttgcctgtatcggctgctctaaaatgtcatatcctccaatcttcacttcaccggaagttgctgaaatatatcccgtcattatattcattgttgtggatttacctgcgccatttggtccaagaagtcccacgatctgtccgtcaggcaccgaaaaactgatatcttttaccgcatgatgttttccgtaatccttgactaagttttttacttctatcataaaataagcctcctgtataatttttatgtactcccggaatctttctgtctttagaaaattcattgcaaaagaaaataccggaaagattgcgggagtacacactcaatgtatagtatattattcttaatttacgatgattttgtgaacatattcttcttttcacattaagttcacattttaaacaaattttgcaaaatgtcttttattgatattttcttaacttttgcttttccatcttttccccttttcattacttttttgttctgcaatttatacatgtccatccttcaccgaactcaaaaaatgaaattcttgcagctatatctatcatttttatccgtttttcacttaaaaatcttaagttaaatgtcttgttatgaaattttttttaaaaaagttgtacttttacttattctttttattgaattacttcacacaatatagtataataggtttcggcaaaagaactcggtgagagatatgattctgatacttttttgtcaatcatcgaggatataaaatatgtataatacacaatatcaaggaggaacagactatgtcttacgttgatgacgtactcgcaaaagttattgcaaaaaacccaagtgaaccagaattccatcaggcagttacagaagtttttgaaactatccgcccattaatcgaggctaatgaagaagaatataaaaaacaggctgttttagagagaatcacagaaccagaaagaatgattaagttccgtgtaccatgggtagatgataacggacaggttcaggttaacatgggtatccgtgttcagttcaacagtgcaatcggaccttacaagggaggattacgttttcatccatccgtaaaccagggtattatcaaattcttaggatttgagcagattttcaaaaactctcttacaggacttccaatcggtggtggtaaaggtggttctgacttcgaccctaagggcaaatcagaccgtgaagttatggcattctgccagagctttatgacagagctttgcaaacacatcggtgctgacactgacgtacctgctggtgatatcggtgttggcggaagagaaatcggttacctcttcggacagtataagagaatcaaaggtctttacgaaggcgttcttacaggaaaaggtttaacatacggtggttcccttgcaagaacagaagctacaggatatggtcttgtatacttcacagaagaaatgttaaaatgccatgacgatgacatcgttggtaagacaattgttgtttccggtgctggtaacgttgcaatctacgctatcgagaaatgtcatcagcttggtgcaaaagttgttacatgttctgattctacaggatgggtatacgatccagaaggaatcgacttagatgctttaaaagaaatcaaagaagtaaaacgtgctcgtttaacagagtacaagaactaccgtccaaacagcgaatatcatgaaggacgcggagtatggtctgttaaatgtgatgttgctcttccatgtgctactcagaatgagctcttccttgaagacgcaaaacagttagttgctaacggatgtatcgcagtttgtgaaggtgctaacatgcctactacattagatgctactaagtacttacaggaaaacggcgtgatgtttgctcctggtaaagcttctaacgctggtggtgttgctacatctgctcttgaaatgtcccagaacagcgaaagattaagctggacattcgaagaagttgacagcaaacttaaaaacatcatggttaacatttaccacaacattgatgacgctgcaaaacgttacaacaaagaaggcgactatgtaacaggcgctaacatcgcaggtttcgaaaaagtattaaacgctatgcttgcacagggcgtttgctaattttcttccttgactattgttacagaaataaattttctcttgaaatcattttttaaatgatatataatcaaagaaacgcaacggagtgttccatttaggaatactccgttttttgttttccaaatttctctattttcggatttgaaaaacattttcctgtgtattatacagtgcagaaggagaaatctccactctattccaccttctgtagtcaatggctacccgcttcgtatagtagtcattctcctgctggcttttcttttgccaactataaagccatgcaggaacaggatgcgtttcttatattatttattatttcgatttacttattaatttacttttggaggtaatattactatggataaaatagatagaaagattctttctcttcttcaggagaatgcccgttaccctttaaaataccttgcacaaaaggtattcttatcttctcctgccgtttctacgagaatagaacgtatggaaaaagccggcattatcaccggctatcacgcaacaattgaccctgttgcattgggatatcatattacagcattcattaatcttactttagacccaaagcagaaaaatgaattttatccttatgtcacggactgccctaatgttttggaatgtaactgtgttactggtacatattctattatgctgaaggttgcttttcccagcacaatggagttagatacctttatcgggcatcttcagcagtttgggaatacacaaacacagattgtgttttcgacggcggttcctccaagaggggtggggattgaaacagatgaaacagatacagcggaggaaatcaaaaaagcataattatcagatgcactctaagatattagctaaaaaatgtattatatgatggattttgatttcgttgtaaaaaacacaaattcacaaaatacatcataatacatttttttactgtttgataatgattgattatcttttttgtcattgaatagattttatatcattatttttcacttatgataaggatgattatggagtattcgatatccccggtagatttgttcgtagagaaccattccggtcatattagaggacatcgtgaagtctgagaggaccaggggttctatagaaccagtacccagttctgcaaatttatccgttgcttcctcattccattctggtacaaagaacataactcctttcatacctgaaccttcccatttttttagctggtcgctgagtttttctgaggtaagttctgctttgccgggctgtacgagtagttttttcatgccggtatctttcgtaagcagagagttccactctttttctttttttacaaatttacagcttattttgcagtaacggctgaggcgtttttcgtattctgcgatagcttttttgcagaatttctgtgattttttgcgttcttgtatatatatttcgtatttcatgattttcctgtatttctatttttgtgtaggttctattatgcattcatctcaaattacacacctttcacttttttatcacagtcagaaaacgaaaacaccatatactcctatctgtgacctcggagcaagtgttggatgtgagtgtttccacaaacactcaacacaccgcgaccaacatcacagataagagtatatggtgttttcgtccggtaaaagcataaaaaagcgaaccagaagggactcgaacccccgacacacggttccggaaaccgttgctctatccaactgagctactggtccacaggaagttttcttaaaaacttccgttgtttataatactatattttacattatattgcaagggaaagtttctttgtatcttcgataatcttcggcattttcccgcagtttttctactgcttctttgatgcattgtacggtgtaatctatttcttcctgcgtgttttgataaccgattgtaaggcgcaaagtgccgcgtgcgagcttctcaggaattcccattgcagtgagaacgtgagatggagaagtgtctcctgtactacaggcagatgcggcggaggcgcagatatttttttcgtctaataaaagtaatagttcgttgccttcgatgaattggaaactgatgttacagttacctggcagtctgtttgtaagacttccatttaagcggcagtatggtatccctctctgtaatctccgtattaaataatctcttaattgctgtatttctttctcccggtactcccttgtggtaaatgcaatttctgctgcttttcccattccagcgattcccggaacattttctgtgcctgcccgatgatttctttcttgtttgccaccgtggatgtattcaggaagagggatttttttacggatataaaggaatcccacacctttagggccattaaatttatgagcactggcacttaacaggtcgatattttctttttttacatctatcagaagctgtccatatgcctgtacggcatctgtatgaaataaaatatcgttcttttcggcgatttttccaatttgtgcaatcttttgtatcgttcccacttcattattagcgtacataaccgaaataagtatggtgtcctttcgtattgctttttcaagaacatcgagtcggatacttccccattcgtctacatcaagataagtcacttcaaatccctgtttttccagataggcacagctatttagtatggcatgatgctcgattttacttgtgatgatatgccgtcctttttcttttaacatttgtgctgctgcttttatcgcccagttgtcagactctgttccgcctgatgtaaaataaatttcttctgctgacgcattcaaagttttggcaatctgttcacggacattttctatcatgccgcgattctctgaggacatttgatagactccagaaggattcccatatttttcacaaaaatatggtcgcattgccacttctacttccaggcgtaccggtgtcgtagctgcattgtcgagataaacctgcttcatagactttcctcttttccatgatttattgatagctattttttatgagcaacttctgaatagttgccttcattttcgcatacaatcaaataaccctttgcctgcggtgtcactatgtcatacaaaaaaatgatttttactggaacattaatcttaactctctctggttttctggcaagaatactcggattctataacagaatattcctctcgaacttaattggtgcaaaagaattaggaatttatcagcttatttttccaatctacatgctctgcttttctttgtgctgccatggatttgagactggcatttctaatctcacctcgcgtttttttgcaaagggacaaaaaaagaacgcacaccatctcgtccgacttggctgccttctttctttttgcctctctattctactgatgtttgccctttttgaaggtgctgattatttaagcacattcattttaaaagaagcctccgccgctccttccctgaaaattgcagctctttctctgccttttgtttccataaaagcctgtcttcatggttactatattggcttaaatcattccagtgttccagcagtcagccagattgtagaacaaattacccgtgtgggtgggatttatcttctgtcaatctctgtttttattatgggcgctgatgcaagaattgctgcctggggaatggttcttggtgaagcagtttccacgatatacactatccttgcctactttcgtagactgtttttcgaaaatagtatctttttccaaaaaaatttgcagaaaaacaattcaaataaaaataagcaaaacaagaaaatttcaaataaaaaaaatcaaaataaaaggattttaaataaaaataattctgataaaatttcaaaaaattataacaaaaaatatgctgataaaagaacattctcccggcaggcagattctttcaccctttccacaagggaacttttagagcactttttttcttttagtattcctatttccgtgaatcatttctgcctcacgattatcagtagtttagaaaccatgctcattccttttatgcttgaaatattttttcacagtcactcgcaggcgttagaaacctatggcacgttaaccggtatggcattgccatttcttttctttcctgctaccattgtaaattccctctctgtgatgctcatgcctgcaatttcttcggcctacgaccaaaaacaacaccggcagatggaaaacacaatctctgccagccttcatttttgccttcttatcggcattttcagcacctttgcctttcttatttacggaacggtacttggggagactattttccacagtaaagaagctggacagtatgtctatttattttccgttctatgtccatttatgtatgccgcacagacaacttcgagtattttaaatggatttggaaagacgaagcagactctttaccataaccttttaggggtaggcatccgaattttctttatcctgcttcttattccatctaaaggaatccccggttatctcatcggacttcttgcaggctatagtcttcagcttcttttgaacttattctgcatttatcagattgtacctttttatttttctgcagaaaagactttgcttttccccgttctaacagcaatcggcggaggcattctctccaaaaaattctggggaattgcctccgccgcactgccactttcttctttttatattttagtaataagtggctttctttattttcttttttttactttgtgtcagatttttcgagaaagtgtttaaaaaatactttctgcaagatgtttgctgcaatttgtgggaacgtgtttacacaattcgggcaatctgctcgcataaaataagacgcatcatctgatgaggaaaggtcaatgctgaaaaactcagcttttcatttgcccgtcgtactactttatctgcaaggcctaatgaaccgccaattacaaaaacaacatctgaagatacagtagaaaatactctctccatccgttttttccacgctgacgtactgtagtgctttccgtcaatacaaagtgcaataacgtaatcatcgtcttttatcttgcttaaaatacgctcgccttccatctcccgaatctgcctttccacagaagcaggacactgatcaggcgtcggttcatcgggacactccatgatatccatcgaatatttttttcggatttcttttacataagcagcaataccatctctaaagaaatcttcttttactctgccgacacagactattttaattcctgtcatacctcttaatcatccctgcggtcgccaaacaataaaaggagacgcagaagctgtaaaatagaagaagccgctgctgcaacataagtaagtgccgctgccgtaagaacctttcttgctccggaaatctcatcatcataaagaatatgcgaattaccaagaatctttaatgctcttgaagaagcattaaactctactggtaatgtgacaagctggaatattactgtaagagaaaataacagcacaccaagcataatcaatgtacggcttcctccaagcacgattccgattaaaataagcggccaggagattgtcgcaccaaagtttacaactggcacaatcgcaccacggattttaagtggtgcataactttctgcatcctgaatcgcatgtccgcattcatgtgccgctacaccaattgcggctacagaactggaacgaaatgttgcatcagataaattcagcaccctgtttgacgggtcataattatccgttaaatcaccggaaatatgtcgaatctccacatcataaattcctgctccatgaaggattttctctgccgcttctgccgcagtaattcccgaatgactcctcactctgttaaactttgcataagtggactttactcttgctgacgcaagcaggcaaatcaccataccgattataactaaaatatatgtcgggtcccagtacatcccgtaatatccgccataatacatagactacacctccaatttacttatttctcaatacggtatgcagcaaccacttctgctgtatacatatgatgataatccttttccggataccatcttccatctacttctggatcaatgaattcttctggatttaactgtgtttccataagcttcttgcagacaaataccatggttccttcctcaaaagtaggctctccctcttctgtctctactacatgaaaatttaccttgctgatcttatcttcatctcttccagatacctttccaagataacccatctcctgtttgcgctcaccatcaaaaaatgtcagtgtaaaggtatctcctgcatccacaaattcctttgtaaaacgctgtggacgaataccaactgtcactacattttttccccagaaaacgcccatcattccccaggaagctgtcattgtatttactttgccttctttctttgcagaaatgagcatccagtcctgaccaattctctgaaaaggatttacatttgcttttgttacatcaattttttcgaacttcattataatatcctcctaaaaatacattccagtataatatagcatctttttaacaaaaataataaaatatgcttcttttcattatcctcttaagattaccgttccactaacttattttagtaatccagtttctttgctgcttctacaatcatttcttctgttacaacatatggataatgctctaaatcttcatctttcaccataaatggcgcacattttgctacttcttctactgtcacacccacttcagaaagctttgctggaaggcccactgtcttattaaatgcgataagcttctggcattcttcctcttttccatcaatcgtaagtaatagcaatacaccaaaaccgacaacaacgccatgcaaatggtcttcatcgaatcctggcaaattacaaaggccgtagaagaaagcgtgtgcaactccaccgttataatccatcgtatgttctcttgccacaagcaaggaaacccagcctgcagtaatgataatatcaagagcaacctgctctaacgcataagatgccactccctgttcattatcttttaacgcctgtgccccatgctcaaccatcgcttccatacacatacggctaagctggacacccatcgctttaaaatgttctaacttctcgcctcttgcagaaatactgacttcataatacttggcataagtatctccaattcctgcccaaagatactcttttggtgcattggcaataatttctgtattgataaatacatgctttgccggctctaagaaatgcacaaacttgcaaaatgtcccgtcttcattatatacaatagaaacagcggaagtcggtgcacagttcgatgctatcgtaggaaatgaaaaatatggcttttcaaaatcaatacttacaagcttacaagtatcaattgcctttcctccaccaacagcaaatatcatatctgcctgccgtactgcctctaactgttctaactttttcgcattgttaaaggtacattcgcctccgaaccatacaaaatcaagaatctctatccctgtatctttcaccgcggcaagcagtttatcctttgcggctgccatcgcttttttaccgccaacaacaactgcctttttcccataaatatggcactgtttttcaatctgtctatatgcttccggtcctaccgtatacggtggaacctgcactgaataattctccataacgtgctcctttctgtccgttttattatagtaaagtaatacttagccgtcaatatgcgattggcattcttgttctttctcaccttgtatgatacactcatagagactattaatctattcatacacagttatgtacatctaaaaacttttatacctgattttgtgtgataaattgccaccaagtcagatagatagggattttaagaatacataaaataaaaaggagtgtttctacctatgctaaacaaacaatatacatccatgttacaggaaaaagacgttatttttgaaatattccaatatgccaccgaacgagcaaaagttgtcggagcagagaacatttatgatttcagtcttggaaacccttccgtacctgcaccttctattgtaaatgaaactattgtccaaaaagtgaacaccttagaccctttagcacttcacggatacagccctagctttggaatcatggaaacccgcgagaaaatcgccgttttcttaaataaaaaatacggttcttcttacaaagcttctaatatttttatggcaatcggtgctgccggagcgttagctcatgcttttcgtgcagtaacaaaccctggagatgaaatcatcacatttgctccttgtttttctgaatataaaccatatactgctggagcaggcttaaaactcaccattatcccggcggatatcgacaccttccagattaacttcgcagcatttgaagcacaattaaatgaaaatactactgctgtcttaatcaattccccaaacaacccatcaggaattgtttattccacagaaaccatcaaaaaattagcagacattttaacagaaaaatcaaaagaatttggtcatccaatctatcttatctccgatgagccataccgagacattatttttgagggagtggatgccccttatgtggcaaactactacaaaaataccctcacctgctattcctttagtaaatctatctcccttccgggggaacgtatcggctatctcgccgtgcatccagattgcatagaagctaacaagatcatcgaaatctgtccacagatttcccgtaccatcggacaaaacggtgccgcttccctcatgcagagaaccgtagcggatgtctgcaattatacttcggatttaagcgtttatgaaacaaataaaaaaatactctttgaagcgctcaaagagtatggctatcattgtgtagagccaggcggaactttctatatgttcccacgttctttagaaccggattcacaggcattttgtaagaaagcaatggaaaaagatttaatgctcgttccggggacattttcggctgcccgggacacttccgtatcgcgtactgtgtaccaacggagagggtggagaaggcacttccgatatttcaggaactagcggaggaatatttataatctactataaaacagacgaccccattgctgaaaagtccccagtctcagccaataaccaaagtcagatcaaaaccacaatagccaaagacagccctcttttgataaataaagcatatttgtggcctcggagcaaaggttggatgcgagcgctgtaagcgagcattcaacctgccgcgactaaagtcacaaatatgctttatttatcaaaagagggcgtctccttcgcctactgtacactttttcagacctgctattctgcatctgctttttccagaaactccacaaactcttcttctggtaatggtttggaatagtaatatccctgaatgtaatcacagccgctctgtcttaagaagcttacctgttcttccgtttctactccttctgcaactgtctttatacctatctcatgtgccattccgataatactatggacgatactttttgtctttggattctcgccaattttacggataaagctcatatcaatctttaagatatcaaagtcatagtcctgcagcattccaaaggatgaaaagccacttccaaagtcatctaggagaatctttgcattcttaattctaaggctttcaagaataccgcttctattttctctgatagcagcgtaggatgtttccgtaatttcaaaacgtgccatatgttctctgccattttccctgaagcgatccatttcttttagaatcttttccatcataatttcatcgtagaaatccatccaggataagtttacggagattggaacaacaaatttattattctcacatcgatcattgataaactgccatacctttttaagaacatagaaatcaagttctgaaatatggccattctcctctaatgcaggtataaacaaagctggagaaataaatcctttatccggatgaatccaacggattaatgcttctgccgatgcaatctttcctgtctttgtatcaattaccggctggtaatatactttaaactgttccttcgcaatgccttcctgtaattctccggcgagcttagccttatctatatatgcaacctgcatggaatgatcatataccatgtatggctgcacatactcatcggtaatatagcgcttcgcaagttttgctctgtcaatcattcccgaaatcttcatcggcttctcttccacataaaaaataccacagcgaataatcaaattcatacacttgccgtcttttacgaacttattatcacaaactgaggtaagttcttcaaaatcaagattcttattctctaccagacatacaaaatgatctgactctactcttgcagtaataactggcgataactttgaatgtgtcagcgttctaaatatattctgaagaaccacatcgccactctccacgccaaacaattcatttaccgccttaaaattcttcacattaaaaaatagaacggcatatttagttctatctggaacctcattcaaaagacgttctgtaattcgaataaatccccgacgattatatccgcctgtcagaacgtctttttctgaaaattctgtaatatcttctctcgctccaacaattatatcaactctctcatcaatataaatataagagtatctttttaatcttacttcccctgttttatctgtttcatgaattgtaaaaaaatattgcttgtctttacgaagcccctcttttattgtggaaagttccacacattttttaaacctctcacgttcactttctacaacggctctgtgtgaactataagaacggtagccttcatatgcctcttctttcttcagataatcagatataacagaagacaagacatctgtctttatcatcttctctctcttcgcatcaataattataatattctcataatccttctgataaatcttctgcggcacattctcaataagatacgctactgtaacatctgtaaaatgtaacacgccttcaatctctcttgaaaaagaattgcatgccatatctacattaatacgaagaacacatggctgttgttcttccgaataaaaaaatgctgcttccatagataaagccgccgtaccctctgtaaaccgcttcaacatattttgctgagagaacacctggcaaaaatgttcccttgattcaggcattggaatcatttcactgactctttgtatatatgtatcgatactttcctcactctgacattctaattcatctctcctgccagcaaaggaaagacaaataccctgagaaatattagctgacacaattcccacagaatccaatgtgtgacacattgctatctgtaaaagtttcaagtagtcatcattaatatcacgaatatacattacaacctgctgattatcttctcgatattcggtgcttcgcacaatttccatggaaacccatcgatactgcccctcaagaactctccgatactgcaggctggcatattgacttccatctaaaaagatttttttcaaatgttctaatgaacaaaactctgtatattctttgtagtcttcttcatgaatataccccttttctgcaacatctttcagacatgcggatatactttccttttgatacagttctcttaaaggatcactattcccctgctctataatctcataagaatctgcctctaaatcaatctttaatatacgatagaaaatcgtagacagcatagtaactgcatcttttaaattacttgaaatattatcataaagagtaatcatatttctaactcttctaagtacgatagctacattaaacggacgtacaaaataatcactcgctccaagctcgtatgctttctttacactttccccgctgatttctgctgaaataacaattactggaagtttatcaagccactttcttcgcttcataatggaaagtacttcatagccatccataaccggcatatttatgtcgagtaaaacaagtttaaactgttctctgttctcctctaaaatatctattgctttcttaccattttcaacttgataaatctcatattcatccaaaaatttgagtaccgttaaccttgatatcgttcttttcaacttgataaatctcatattcatcccccagcatacctgcgagaagttcacggttcagctcagaatcatctacaatcaatattttcagtttatctgtgctctctctgacatctatcattttctctcaccccgcttctcacgccatgctataactggacatagcaacacacgttaagtatatcattaatatgacaaaaagcaacgaaatttataaaaaaagaggggagaacttctatttttaccccccccttaaaaaattacatttttcagtgttctttcttatattttaactatttatcaattattactgtatcattttataattcaagaactatccttattttcttttgatacatattacacaactttaccatctgtgagcaattacaaattaatcctcaaaatatctttctaagaactgtcttgttctttcttccttcggatgttcaaatacctgctctggagtaccgtactctgcaatcgtaccctgatctaagaaaagaactttatcagatacatcacgggcaaacttcatctcgtgcgtaacgataaccattgttgtatggcgatcggcaagtccgcggataacttttaatacctctccggtaagttccgggtcaagtgcagaagttggctcatcaaaacataaaatgtcaggctgaagcattaatgctcttgcaattgcaactctctgctgctgcccgccagaaagctgatgtggatagtaattcattttttcttttaagccaacactctcaaggagtgcttctccctctgctgtgatttcatccatgattttcttcttattctctttaaaatccgggcgttcctttgccattaattctctggctaatgtacagttgcgtaacgctgtatattgtgggaaaagattaaaggactgaaataccattccaaaatgtaaacggttctttcttatctgtgcatctcccagagatttgttatcatcggcatcaaaaatcactttattatttacaataatctgtccatgtgtggggcgctctaaaaagttcaggcagcgcaaaagtgtcgtctttccacttcctgatgctccgatcattgcgagggcttctcccttttccagagaaaaatcaatgccctttaacacttcaagacttccaaaattcttttttaaattctttacttcaagaatagacatcaaaactcctccttatactctaaagtaatccattttcttttcgatccatccaaataaaattgtaaggataccattgaaaacaaggaaaaatactgcggtagaaaacagtggccagataagcccctgctttgtaaaacgctccgcacacataataatctctgcaagaccaatgattcgtgcaagtgaagtatcctttgtaagagtaataacctcgttactcagcggtggaataattcttttaataacctgtaacagaataatcttaaagaaaatctgtgtctttgtcataccaagaacctgacctgcctcgtactgtcctttagacacactctcaattcctccacgataaatctctgaaaaatatgctgcatagttaataacaaatgcaataactgctgctgtaaaacgagaattcatcggcatggaaaataaaagtcctggtgcatacaacacaacaaaaagctggagcatcagtggtgttcctctgataatccagacgaaagttctgctcagccattttaatggcttaaactttgacatagaacaaaatgttatcactaatccaagcggcaatgccagaagtaatgtgataaaaaacagctcgatgttaataatgaatcctgaacttaaggattccattgggctggtagccatcataattttttccttctttctttataaaaatatttgatatatcttcgcccgaaaccacaacaagaatccggtctttccgtctctttcttttttattaaaagacaccgaaatcccggattcctttctatgtattctcacgaagcctatatagtttctctatcataccatagaaataactatttaatcaacatctcctgtaaaccatatttctttgcaatcgtatctactgttccatcttcgtaaagttctttgattgcttcatttactttttctgttacatcgcttcccttacggaatgcaataccatattcctgctgaccaaagttgttatccatattgattactaaatcagaataatctgttccttcaccaaccattccaagtgcacaaacactatcaaccaaagcaacatctgctgtaccggattttacttccataagagcctttgccatagaatcagaagcaacatagttcgcatctttgaaataatcctgtgcagaaacctttacagtatcatcatctgcgatagaaccatcaatctttccctcacctgtagaaccctgttctgctgtaacagtgagaccttttacactcttcatgatttctttttctctggattttttcattaccatagcctgtgtattataaagatatgggtcagaaatactcatattctgctttctctcttctgtgatacacataccattccagatacagtcaatattcttagaacttaactctacttctttagagtcccagttaatctcagtaaactctacatcaatgccaagcttctttgtaactgcctcggccatctctgtatcaaaaccaacaagtttgtttttctcattgtaatagttcattggtgcaaataatgtgataccaacagtgagttttcccttatcctgaatgtaagcccagtcagaatcggaacctgcacttgttgaacctgcttcattaccttttgatgaaccacaaccgactaatcctgtcacgctcattacaagaactaagagcattgcaattatctttttcatagtattctcctttttctttcccttataatctctgcatagttttatcaatgcactacactaaagtattatagccagaaatttttattttgtcaagggaaattgacacgtccagagagaatctatcccatgagctttcatctcccagaacttctacatctcctgtcctcttttccaaatctctccagctgattttctaaactgcaactgccaacgagcagaactcagggagataaataaagcatattcgtggcctcggagcgaggtttggatgcaagcgcgtaaagcgagcattcaaaccgccgcggctaaagtctcaaatatgctttatttatctccctgagttcgtctcccatgcctgcagcaaatcagagcttaatatcttggtgttaattctacatacatatctttatactgttttgcactctgttcccaggaaacgtctttgttcatatcacgaactaccatgtcatcccagtacactctgttttcaaaatagagtgtttttgctctattgattgcatcgtaaaggagtccactttcatatctgtcaaatgtaaaaccattgcctgtgttttcaaatgcattataaggctgaacagtatctttcaagcctcctgtttctctgacaattggaacggcaccgtatctcatggatatgagctgtgtaagtccgcatggttcaaatcttgatggaactaaaagcgcatcacaccctgcataaatattatgagccacattttcattgtaggcaatataggcacagaagctgcctttatatttatcttcataataacggaaggtgtcctcatactgggcatcacctgtaccaagaacaactacctgcgtatttccatccatgatacctggaattacgtcatttacaaggtcaagtcctttttgatttgtaagacgggaaataagaccaattaccattttattgtcgtccacatctaatcctaaagattcctgaagagcttttttatttgcctttttattctttatcgctgattctgcatcatacttagaggctaacagcttatctgttgccggattccagatatctgtatcaataccatttacaattcctaaaaccttattattgtgatatcttaaatgttcttcaagtccctcaccatattcttctgtctgaatctcccaggcgtaagtgttacttaccgttgtcactttattagaataagtaataccaccctttagcatattcgcatccagccagttctgaatcatacagtctttattaaatacataatcaggaagccctgaccaatactgaatcgtttttctgtcataaacaccctggaatcttaaattatgtattgtgagtactgcaattgcacgtcccacatttgtatcactaaaacaggttcttaagtaaagcggcactaacgctgcctgccagtcatgacaatgtactatgtctggagtccaatctaaataattaagtgcagcaagagcagccttaccaaaataacagaactttggaatatcatctataaggttcgtatatgggtctccccaggagaaaaactcatcattatctataaaatcatagacaacaccatcttcctgatattccataattcccacataatactgttttccatcagcacaaagatccatatagaaagagcccctgtattccatcttttcctgatacttctgaggaatacatttatatcttggcaaaattaccttaacatccagatttaactttgccaaagccttaggaagagcagacattacatcacccagtccaccagtcttaacaaatggataacactctgaaccaataaacgcaacacttcttctcggacccaaatctggctgctccatcgggatatcctgcttaacagtggtctgtggttcagctacttctttcttagacggagcctctgccttaactgccacttttttagctggcacctttgtctcgatttctactttcttaactggctcctttacttcaacttctgctttctttgctgccggctttgccttaactgtcttctcctttacctcagtcttcggctctgctgcttcctctttcttaaccacaggctttgctttaactgccgcttttttctctgaagtttttgccttagctgtcttcttctttgctgctggctttggcttaaccgcttcttccttctttgcctcaggctttgcttcaaccgtttctttcttctctggagtttttgccttagctgtcttctttaccgcagcctttggcttaactgcttcttccttctttgcctcaggctttgcttcaaccgtttctttcttctctggagtttttgccttagctgtcttctttaccgcagcctttggcttaactgcttcttccttcgctacagtcttcggctcaactgttgcctccttaactgaagcctttacttcagcttctgcatttttaacagaagtcttttttgctgttgaactacttttagctgttgttttccttgtactgatttttttagccatctctctctctccaatccacaaaatagtattatatattataattttaacaaataatacaactacagtcaattgaggaaatcctgatttgccgcaggcaagaagacgcccccaaagagagacaataccctatattggtgactttagtcgctgcaggttgaatgttcgcttaaccgctcgcatccaacctttgctccgaggccacaaatatagggtattgtctctctttgggagctgtctttggctgcctaagcaaaatccgaatttattttggagggatttagggaagaaggccaaagacatagaaatatccagaaaattaaattctataggattgacatataagctattgtcatagtagcacaatgatttgtggttaggttattacttttttgtgaactggaaatttggactgatttatggctttagagcgtatctgaaaataaagtgtttccattaaaaatgcgaacgaaaactatattactctataaaagaataaataaaattccaaattcattttaaaaacatttttcacaaatggttccagtgtcaatccttcagaatatcaactccccataagatcacaaccgtctgaagcctccctcaaatctctccaacattaaaattctgattttatttttccagccaaagtacagccctctggaaatgaaataatccttatttgtggcctcggagcaaggtttggatacgagcgtgtgtaagcgagtattcaaaccgcagcgactaaagtcacaaataaggattatttcattccctgagggcgtctattttgcctgcggcaaatcagaattgttatgaagcagcttatgttcttttcccttcaaaagcccttcgtaaagttcccccacaatcggattatcattcgagcgtttaatctgtgaagcatcatcaattcgataaagcccctcatatctggcagctttcgtccttgcaccaattggtaccggctgtccgccgcctgccatacatcctctgcggcatgccatgacttctacaaaatcatattgtacctcgccgctttttattttctgaatcagttcatcagcatttttcagaccgctgactacggcgattttaatctgtctgtctccatatggaataaccgcttcttttataccatcagttccccggattccagtaaatttgatttcgtttaatgcttccatgccactgtcttccacaagtcggcgaaggacggcttctgtcacaccgccagatacgccaaagataactcctgcaccggaagacaagccaaacggcatatccattgcctcccacggcatctgtgccaagtcgattcccgcttctttaatcatgcggataacttccgttgttgtcagtacgaaatccacatcctgctcgccttctgttttgtgttccggacgaagaatttctgcctttttggcggtacatggcatgatagataccacaacggttttccttgtgtcttttttattgtttcgtgcttcttcttttaagactgctccaaacatttgttgcggagaacggcaggttgagatatttgcacgaagttccggatatttttgttcgcagaattttacccatgctggacaacaggaagtaaataatggaagtttttccccagattccactctctctaaaaattctttggattcttccataatagtgaggtctgctccaaaatcagtatcatagatttcatcaaatcccattcgtcgaagagctgctaccagttttccaagagagttttccccttttggaataccaaatttatcaccaaccgccactcgtactgccggagcaatctgcacaataactcttgtatttttatcagcaagtgcttcccagactggatgaatgttatgtttgatagttattgcacctgtcgggcatacgacacggcattgtccacagccaacacaggcagtctcggccattttcctgtcaaaggccggcataacctgcatttttgaaccacgataagcaaagtctaaaataccaagtccctgaatttcttcacaggttcttacacaatctccgcagagaatacatttatttttatcaataacgatacagtcagaactttcatcaatcggaatctgcggtttattattttcaaagcgaatgtagctgacaccaagctgcttggcgagattctgtaacgtgcagtctccattttttttacacgttgtacattccctgcaatgagccgaaagcattaattctaaaatcattttccggtgatgctgtaactttggcgtattggtataaataaccattccgtctcttggcacttcagaacaggaggcaaatatctttcctctgtcatcttctactacacacatacgacaggctccataggtggaaagttccgaatgataacagaatgttggcagattaattcccgcctttctgataacggaaagcacatttttttcatcatcaaaggcaacttttcgattattaatggtcatatatttcatcgctttcccctcctatgcttctatatgaatagcgtggaatgcacaggcactctcacaggctccacatttaatacaaatgctgtcatcaataacatatggcttcttaatctgtccactgatagcaccaactgggcagtttctcgcacattttgaacagcctttacagcgttctggactaataacaaatcgacgcagtgccgtacagttcttcgctgcacacttcttatctacaacatgttcctcatattctttgcggaacagtcggagagtactcataaccggaagtgcagcactctttccaaggccacaaagtgcggtatcggtaattgtagatgccagttcatcaagaaggtctaaatcctcccgagttccctttcctgcgacaatccgctctaaaatctcaagcatacgtttcgttccctcacgacaaggaacacacttgccacaactttcattctgggtaaagttcataaagaaacgggcaacttctaccatacaggtcttatcatccatgacaacaagaccgcctgagccaatcattgctcccatcttctttaaagaatcaaaatcaaggctgacatccaaatgcggtgtgataagacagccaccagacggtcctccaatctgtactgccttaaacttcgcatctcctttgattccgccgccaatatcataaataacttcccgcaaagaagttcccatcggcacctcgataagtcctgtatttttcacacttcctgtaagagcaaacgctttcgttcccggactattttccggtccgatactccgataccattttgctcctttttctataatcatcggaacattagcaaaagtctctacgttattcaataccgttggttttgcaaacaatccctgctctactgttcttggcggttttactctcggcattcctcgttttccttcaatagatgctgtaagtgcacttccctcaccacatacaaaggctcccgcccccctgttaatatgtaaatggaaagaaaaatctgttccgagaatatgttctccaagaagtcctctatcttctgcctgagaaatggcaagacgaagacggctgatagctaacggatattctgcacgaacataaatatacccttcctgtgcacctactgcataagcagcaataagcataccttctatcatcttatgcgggtcaccttccatgatacttctgtccataaatgcacctgggtcaccttcatcaccattacaaacaatataacgaattttctcttgctgccttgctacctgtttccatttataaccagtctgaaaacctccgccaccacgtccacgaagatttgactctaaaatagtctcaatcacatcatttggagtctgttcaaacaaaacttttgcaaaggattgatagcctccaaccgcaatatattcttcgatatgttctgcatcaatatgtccacagtttttaagtactaaacgagtctgtttctcataaaatggaatttcttcctgcttcggatattcaataccatcctgcttatacaaaagatgatgaataatatttccatgctttattgttctctcaaaaatctcttcacagtcttctggctttacctttgtatagagaattccaagcggctcaattctcatcagcggtcccatctcacaaaagccatgacagccactgcgttttacagcaacaggaatttcaattccagatacagattccccttatctacatctgcatctatatctttatttatatctacattactattttcctttgtatctttctcactgtgtgcaatctctgctccaaattctacatcaacatctttacaatctttcgtgagttcacacattttctcataaatttctccagaaccaccagcaagacatcctgttccggcacagattaaaatccggcactttgtagaagaaacttttgcagctgccatatcccgaatctgatctaactcttctctgttctgaatcctcatcccctattcctcctctcgaagtttttgaagtaactgtgcagcgtcatctggtgtcattgaaggatataccttgtcattcactgtcagtactggtgcaagaccgcaggcaccaagacaagataccgtctccactgtaaacaacatatcctctgttgttaccttatcttttgaaagacccagctcactataaattcgctccaaaatcgttgtggatttacgaacatgacaggctgttccatcacagactttaattacatatttgccctttggttcaaaagaaaaattctcataaaatgtagctacactaaacgcctttgcctctgtaatccctatctgatctgcaacataagataacagttctggcggcaaataacgatattcactctgaatatcctgtataatcggaattagagatgcctccatagccccatgagacttgataatcgtatctgctttgtcatagtaacccttctctaacataagcctcccctttcataaaaaacttctttcgtttgtcatagccgaaacttcactacctttcggttatggataattgaagcagctcacatttagacattgtgaacaatttttcaatcaaatcccctttattatcctcttttttgataaataaattatcattatattcctattatattaaaattttagaaaatttacaacatatttttgatatatttttaacattttttaagcaaaacttttatattatccaaaaaatttaaattctgatttgccgcaggcaaaggaaacgccctctggaaatgaaataatccttatttgtggcctcggagcaaggtttgaatactcgcttatacacgctcgtatccaaaccttgctccgaggccacaaataaggattatttcatttccagagggctgtgctttggctggagaaataaaatcagaattttaatgttggagagatttgagggaggcttcagacggttgtggtcttatggggagttgacgttctgaaggattgacactggaaccatttgtgaaaaatgtttttaaaatgaatttggaattttatttattcttttatagattaatatagttttcgttcgcatttttaatggaaacactttattttcagacacgctctaaaaccataaatcaattcaaatttccagttcataaaaaagtaataacctaaccacaaatcattatgctactatgacaatagtttatatgtcaatcctatagaatttaattttctggatatttctatgtctttggccttcttccccaaatccctccaaaataaattcggattttgcttaggcagccaaagacagctcccaaagagagacaataccctatatttgtggcctcggagcaaaggttggatgcgagcggttaagcgaacattcaacctgctgcgactaaagtcacaaatatagggtattgtggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgctcaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataaaatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatctggtccaacttaaagagccggtataatggctgtaccagagcctcaaacaacccagcatttattgcagaaaacattcttaatagagaatttaaggcggaacaccttaatgagaaatgggttaccgatgtaacggaattcaagtatggaaataccttagacagtgtacataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccattgtctctctttgggggcgtcttcttgcctacggcaaatcagaaattaattcccagcttttcgctgctttctttgattactttttctaattcgctatctgtaattgccgttactcgaccagtttcatattctttgtcaacccatttttttacttcttctacaagagggctctttttatctactgctttatcccccttcagacgatagtaggtattcatccagtgagcaattccggcaagtccgcttgtattagatactgctacgagtaccggacggtttaataatttatctgtatcaaaaatattataaatttcttcatttttgaggagtccgtctgcatggattcctgctcttgttacgttgaagttctttccaacaaacggtgttctttctggaatgtgataaccaatttctttttcataatattctgcaagttctgtgataacagttgtatccattccatctaatgttccacgaagctgtgcatactcaaataccatagcctcaagcggtgtatttccagtacgttctccaattccaaataatgcactatttacagcggatgctccgtaaagccatgctgtggtggaattgttaactgccttataaaagtcgttatgtccatgccactcaagaagttcagatggtactccggcatgttcttttaatccgtaaatgattcccggtacggaacgcggaattacggctcctgggaagtttactccatatcccattgtatcacaggcacgaatttttacaggaattccatattcatcttttaacttcataagctctaagcaaaatggaataacaaatccgtaaatatctgaacgggtgatatcctctaaatgacatcttggactaattcctgtttcgagacactctcttacaacacctaaataatgctctaatgcctgctttcttgtcattttcattttatagaaaatgtgatagtcagaacagcttacaaggatacctgtctcctttaagccgatttcttttactaattcaaagtcctttttacttgcacgaatccagcttgtaatctctggaaatttatatcccttttccatacatttatatacggcatctcggtcctttttgctatataagaaaaattcacactgacggataattcctttcgggccgcctaaacgatgaaatgcatcgtaaatatgtacaatctgatctgtagaatacggtgttcttgactgctgtccatcacggaatgtcgtatccgtaatccagatatcttccggcatttcatgcggcacaattctgtcgttgaacgcgatttttggtacttcctcataagggaaaagattacggaatacattaggcttatccgtatcaaccagcgggtacatatattcatctaatttcaataaatttgatttcttgttcagccgaactgagcggttatccatttccatagttctctctccatttcttttattcatagattaacaatcattcagggctttccttcaaaattataatttttttgccctgaacgcttgcccaaattgcataatttaaatataaaaatttcattttattcccgttactattttatcatcaaagtgaaatttgtcaagagatagtctttttacgctactttcatactattttttcgcataataaaagaatcagaactgcatttgctttatcatagcagagtgatagattttctgtttaatttgagaagagctgacaccccagaaaagacagataccctatatttgtgactttagtcgcggcggtttgaatgctcgcttacacgctcgcattcaaaccttgctccgaggtcacaaatatagggtatctgtctcttctggggctgacaatggctggatttggttgaattaaaacagaatggggaagatttgaggattctccgggagattgcgtggtttcataatggaatctatatggcgaaacatatccgtctgagccccaaagcactcctaccttaaatagtaattttgttcgacagccaaagtcagctcacagaacgatacataagcttccgtcttttgcctgtggcaaattctattttttaacttccactttctgtccgatcttgctttcggttccagacagaagtctgccaatattcgctctatgtctgtagattgcaaagaaagcatagagcacacacatcgcaaataagtcccatctgcctggatggaaaatgagaacctccactacgattcctgcggacaaaaggatggatgctaatgatacatatcttgttgctgctgttacaactacaaaaataatgaaacagcataaaccaattctccagtcaaatgccatcatagctgcagcagttgtagcgattccctttcccccttaaattttaagaacacaggataatcatgtcccattactgcagcaaatcctgtaacaagctgaatgaggtctgcgttcagtgtcggcactgccggacagagtaaaaactttactacaagtactggaataaaactttttaaggcatctcctaagaaagtaaggagtgcgcgggtcttgccaagtacgcgaagtacgtttgttgtaccggagttaccgcttccataatcacggatatccattccgcataattttcctacaaggtaaccgctctcaatacagccacagaaatagcctgctacgattacaagtacataatatacagcgttattcatttacttctcctttctctcacgataaatgaaatgaatcggagttccacggaaaccaaaagtggtacgaatctggttttcaatgtatcttgtataagagaaatgcgttagcttcttctcattaataaacataacaaatgtaggtggctttacggaaacctgtgtaatatagtagattcttaaacgcttacctttatctgaaggtggctgcttcatagccattgcctctgtgagaatttcattcaatacaccagtctgtactcgtaatgcacagttttcaattacggcatcaatcatttcaaacaattttggaagtctctgacctgtttttgcagaaaggaaaataagttctgcatatggcatataggaaagtttctcacgaatcttttctgtgaacttcttcattgttgtgttatctttttctaccaagtcccacttattgactgcgataatcataccttttccacgttcatgggcaattccggcaatcttggcatcctgctcggtaatcccttctgtcgcatcaataattaagacagcaacatcacagcgttctacagctgtaacggtacggatgatactgtatctctctaattcttctttaatcttactctttcttcgaagtcctgctgtatcgataaatacatattcctgtccattgcgctttacagttgtatcaatcgcatctcttgttgttcctgcaactggggatacaatcacacgctcctctccaagaagtttattgataatagaagactttcctgcatttggcttaccgattactgcaatcttaggacgatcatcttcttcctcttcttcctgtactggtgcttcaaatttttcaacaacctgatcaagcatatcaccaattccaagcttgccctgtgcggaaactggaatcggatcaccgagtccaagattatagaattcatacacatccggcataaatttatcaaaattatctaccttatttacaacaagaacaactggacgatgagaacggcgtaacatatctgccactttaaagtctgcatccacaagtccctgacgtacatccacaaggaataaaataacatcagcagtcataattgcagtttctgcctgctctctcattcgtgagatgataatatcatcggattccggctcgattccgccggtatcaatcagggtaaactgatagtctaaccagctaacctccgcatagatacggtctcttgttactcctggtgtgtcttctactatagaaattctgcttcctgctaacgcattaaacagcgtagattttcctacattcgggcggcctaccaccgcaacaaccggtttactcataatttcctccattctctattgcaataattttatctacaaagtctcgtccctctgattgtataatattcacgggaacttgtaaagaatcggaaagtccctttaatgaaatatcatctaggaaaatgtcctcatctgctttcagtacattacatggaaggagtaattcctcccctaattctctatccttcaactgtgcgataatatctcctcctgtcaaaagaccggaaacggtgatatgttcgccaaaaaattcattcttaatacagtacacatgtacttttatatgtggaaactttttctccacatctctcgcaagtttctcaatggttgggaaagcaagctttgctgttgcaatggatactgtcttctccctgtcatctccagaaagctcctctaaacgttcctttacctcttctagcaaaaggcgcatcattccacaccattttcaagctgtccatacccttcatagtaagcctcatctgggaattcctgcccggcaaggataaaccactcgtcactggcatgaacaaaggttgttccataattttcacgaaaataatcctgccatttatgaatctgttttaaaactttttttgcatcttcttttccaaaaagttttaatggagcaagtccctctctgtactttgtaagtccgaccggaacaacagacagactctccatatgtggaataaactttccaagatcagaaatagtacggtcaagttcttcctcatcatttaatccctgacatagtactacctgactgttcatacggatacctgcctcatagaaacgtcctattttatccaaaacatcgcctgcaaaacggttatgaagcatcttacaccgaagttccggattcgtcgtatgaacagaaatgttgattggtgaaaggtgatatttgattactcgctcaatatctttatccctcatatttgtgagcgtgatataatttccctgtaaaaaagaaagcctggagtcatcgtctttaaaatacagcgtatctctcattcccggcggcatctgatcaataaaacagaacatacacttattacagcaggaatgatattcgtccataagggaagattcaaaagtaattcccaaatcttcatcttcatccttctcaatctccagaacgcactcctcgccatcctttgtgagaatcagaacatctaagtattcatcttccacataatactgataatcaaatatatcctctatttcatttccattaatttcttctatcgcatctcccggctctaatccaagttcttccgcaatacttcccggctctacccacgcgattttatgcaaatgtttcttcattttctttcctcatctacaaagattctattataaatcgtatatgctatcatttaaactttacaagcgatctgcttctctcactttgtatcactctaaacaaattacagctatacctatttgtgtttctgccacattagaaaattaattttattttgttattctagagcgtgtttgaaaaatgctctaacgaactataaacacataaaacagccaagatttcctctttttccatgacttgcccggtgagaaaacagcttatcgctattacagcaggtacaaatatcggtaatatccagattttctttacggatgcctgcctgtgtaagaatcagttcatttgctttccataaatccagttgatatttaccattgcccttatcatccataattaatggaatctcttctggtaaaaatacttgtttaaattcttcggcaacttcttccccgacttcataacaacttcggcaaatagatggtccaattgccgcaataatattctctggcttactaccatattctctctgtatatatgcaacaaacttcgcaccaatttttgctaccgttccacgccagccggaatgtgccagccctgcaacatgatgttccggatcataaaaaagaagtggaacacaatcagcgtaagaagtatacatagggattcctgcttcatctgtcacaagggcatcaattcccggcacagtttctctcacaatgccatcccccttatcctttgctgtaactttacgtatctctgtctcatgaatctgagaagacaacaccagatcttttgcgtcaaatcctatcgcggctccgattcttcgaaaattctcctgtaccttttccgggtcatcaccgcgggtaaaagataaattcatagaggaaagatgtccctcactcactccaccgattcttgtagaaaaaccatgacatactcctgcctttacaagcttgggaaaggtaagaaataccactccatttttctcatttataattgttgaatgattctcattagcgtatacaaaatccatgttttcctccatattttctgttcacccttgaaattcaaatgcattctgtatccagtgacaccgaaaatctttatctacttctatcacatcaaaacgaaccgccgtattctctgcaagtctcctctgcattcgataataattaaatgtatagcagattctcttttgctttctgaaatcaaccgcttctgctgcagttccgcaatctccatagcttcgcatctttacttctacaacaagaatcatctcctgctctaatgcaataatatcaatttctccgtggtaacttcgaaagtttctctccagtatgcgaataccttttccctcaagaaaaaggactgccgcctcttctgcggcacctccagaattctttcgcacagattacttctccattcttttataaaatatttttaagaaaactacatcgatgaatcggacacggaccaagtcggtgcaaagcctcaatatgttctttagaaccatatcctttgttcgaagcaaaatcatatcccggaaaaactttatcatattcttccatcatatggtctcggtaaacctttgccataatactcgccgctccaatagaaatactctttgcatctcctttgataatcggcacctgttttatatccactcccggaatcattactgcatcattaagtaaaagttccggctttacggaaagattggcgattgcctgacgcattgcttcgtaagttgcctgtaaaatatttatctcatcaattcgctctggcgaagccataccaatgcctacggataccgcttcttctttaataatatcaaataattcctctcgcttctttgccgaaagcttctttgaatcattaatatataaaatacggctgccttttggcaaaacaacggctcctgctacaaccggaccggctaacggacctcgtcctacctcgtcaatcccacagataaagtcatactgactgtattccttttcatattggcacagattctctatacgttctatttcctgataatatttatctactttcttttgctgagaaagtaaaaaattctgtacaccctttctctcatcttcctgatacagggcaatctgtgcagtaatctgctctggagtcagatttttaaactcctcttttatcatactaatgcttttcatttttatgaaacctttccaaacttagtcaaaggccagattcttatccacaccttaccaataatctctgaacggtgtaccggtccaacttcctcataacggctgtcatagctgaccggacgattatccccagacaaaaatattcatctttccctagttctaacggttcctctgctattcccggctcatcaatatattttgtaatgccgtaaatatcactctttaacttcttcccattaatatagaccttacctttttttatctgtaccgtctctccaggcagcccgatcacacgcttaatataatatggatgttcgccgtattcttccgggcctggaaaaataacaatatcatatctctccgggtctcgaaaatggtaagataatttatccataataagattctgcccgtcagataaagttgtatccatagaatccccacgtacaaccgttctctgacctacatagtgaaggataaaatataccgccgcacataaaatagcaagatataaaatggtactgataatttctctcacgttctttcttcgctgctcttttcttctgcgttgtcgtcttcccaatgttacttccgggtttttctttgttctcctacccatacttcgcagacacccctcatttaagacaccttgccaaacttagtcaaaggccagattcttatccatacttttcctacaataatagaccgttttaccggaccaacttctttataacggctatcctgactgactggccgattatcccctaaacaaaaatattcatcatcaccaagcgtaatcggttcttctgcaattcccggataatcaatataatctgtgataccatacacatcactctttaattctttatcattgatataaactttaccatctttaatctgtacagtctctcctggcatcccgataattcgcttgatataatatggatgctgtccaaactcttccggacctggaaaaataataatatcatatctttccggatcatggaatcgataagaaagcttgtccataacaagattctgtccattggccagagttgtatccatagaacttccatttacaacggttctctgccctacaaaatgtagaatcaaaaatacaaaaacgcagactccaattatgtatgcaatcgtacccaatatattctgggcagtacttttttcttttttctcactcgcgtttttcttctctgcttctctttctttactgcgcatcaggcacctccaaagataactttccaagacgtaaggaacggaaatcttctaaaagcagtcttcccgccttatcaatatctgtctggtttcctttcatcagacatcctcgtattcttgcaatctcttcaagaatctctaagttttccttactctcatccacagaatagcgttctaccagcactcctggataagactttttcaaaaagccgatgaattccattgccatctctgttgtattaagaatttcttccttaatagaaccaatgagcgccaggcgaagccctactgcctgatcttcaaacttcggccataaaatacctggagtatctaaaagttccacatttttattaatcttaatccactgttttccctttgtaacacctggcttattgccggtcttggcacaggcttttcctgcaaaagaattaataaatgtagactttccaacattcggaattcccactaccatcgcacgaagcgggcgatttaagattcctctctttttatctcttgctttcttctcctgacatgccttttcaattaaagactttacttccttcatcccggcgcctttttgtgagttcaccttcgctacaaagaagccctttgcctcaaaatagttctgccatgccgctgttgtctttgcatctgccatatctgctttattcagcacgataagacgatatttattctttgccagttcatctatatccggattcttgctgctaaatggtactcgggcatccaccagttctaccacaatatcaatcagcttgatattctcctgcatcattcttctggccttcgtcatatgaccaggataccactgaaaatgcatctttttccctccttctatatattatctatacttattatgctatcacagtcttccctgtactgattctatatttacttctgtacttgatttacagttcagatttcgataaacatatctttcctactgtcttgttactttatgaagcgttcctgctattttacctacaaattgtgaacgtttgatgtttccaatattggatactctggaatcttcgctgttattgcagttatctcccattacaaaatactcatcctcaccaagttctacatcataggcagcaagtcctgctgaaaggatgtcttcttctgaaaacccttttaattctttattatttatataaatctttccattctctatcttaatggtctcacccggtaatcctacaactctttttaccgaatagtgcgtggtagagccattctctagctctaaaatgactgcatcaagccttttcgggcttccaattcgataatccagcttattcaccaacacagtatctccgtcataatatgccggctgcatggagtcgccgtgtacggtcactgtctgaaagcaaaactgaatcactaaaaatgctaacaggattgctgcaacaacttctccaacccaaagaccgattcggcgaatcatcatgtttcttctttctaaataacgataatttttcatctgctttcaccttttcccggaaatctgtatggaaaaacagggcaagtataaatactcgccccggtcttttgtgatactatttaactaattcttttaccttagctctcttaccgattctatcacgtaagtagtaaagttttgctcttcttactttaccttttcttactacctgaatctttgtaacgattggagaatgtaatggccatgtcttttcaacaccaacaccgttagagaactttcttactgtgaaagtttcttttgctccaccgttctgtctcttaataacagttccttcgaatacctggatacgctcacgggaaccctctactaccttagcggaaacacgaactgtatctccaacacggaaactgtcaacttctggttttaactgtgcatcttcaatgctcttaataatatctttcatgtgtgacctcctatatattctcggtgttcttaatacctaaacgtaaaagcggaccaccttttttcacaactttttaataataacatactattccgactcatgcaagcctttttttagcttttttaaatacttttcatcttctttagataaaatggctgtttcaataagatcaggccgtctttctaatgtcctttttaacgactgttctcttctccacttatctatattcccatgatgtccagaaagaagtacatctggtacctttcttcctcgaaattctaccggacgggtatactggggatgttctaaaagattgtcatggaacgattcaaactctgcagattcctcattattaaggacaccaggtacaagacgggaaaccgcatcaatcataaccattgccggaagttctccccccgtaagcacatagtcaccgatagacacatagtctgtaacgatttcttctaaaattctctcatctactccctcataatgcccacatagaaaaatcagatcttcttctttcgaaaattcttctgccattgactggttaaatacggatccctgcggtgtcacataaaccacccgtggctttttctccatgttctgagtcacatcctcataagcaagataaatcggctctggctgcatcaccattcccgctcctccgccataaggatagtcatctacatgtttatgcttatctttggaataatcccggatatttaccgcactcagatgaatatatccattcttcaatgctcttccggttacacttgtatgaagccctgcctcaatcatatccggaaacagggttagtacgtggaaattcattaatccaccagacctttcagcatatgaactaaaataatcttctcttccatatctacatctaagatacagtccttaatcgcaggaagaagtacatgtcctccatctggagtcttcacttcatatacatcgttcgcaccggtttctatcacatcaataagttcaccaattgtcacgccgctctcatcaacgattgtaagtcccagtaaatctgcaacataatattcatcttcttctaaaggaactgcattctctctcgtaaccttaagagggcatctcttatatttttctacatcattaatatcatcaagcccctcaaactttacaaatacaaactgtttgaaaaacttgcagtactgtacctttttctcaatcagttcctttcctgtatcaatgagaactgtatctaagtcaagaaatctttctttatcatctgtcgtaggaaaaactttgacttcacccttcagtccatgtgttcctgtgatgataccaacctgaaataaatcttccatacctttgttatctccattctgccgtcacatttttcgttatatagaaaaaaatgttacctgctcaaacgtttacaggtaacatttcaaatgcctattactgtgcgatatcaactatcacttttttatcatcacgggaagctgctgccttgacaacagtgcggattgccttagcaatacgtccctgcttgccgattactttgcccatatcatctggtgcaacatgtaattctaagataatggagttctctgtctccttctctgtgacaacaatttcatccggatgatcaacaagagaaactgctataacttttactaactctttcattatattagcctccagttattatttctcaataccggcattctttaataatcttgcaactgtatctgtaggctgagctcctttagaaagccagtcttttgctgcttcttcatcgattttaactacgcatggttcctggttaggatcgtataaaccgatttcatcgatgtttctaccatctcttggagatcttgcatctgcaactacaattctatagataggatttctctttttacccattctttttaatctcatttttactgccatgtgattcacctctttcataatatttgtatataaattaattcatctatattggaaccggtaccccggataccatcgttcatcaaagctttttaaaacggaagcttcattccgccaagattgaatccgccttttctgcggccgcccttgcccatcattccattcatctgcttcatcatcttacgcgactgttcaaactgcttacaaagcttattcacatcctgaagctttacacctgctccattcgcaattcgcttctttctggaaggattcaaaatattagggtttgctctctcttccggtgtcatggaataaataatcgcctcaatgctgtccatcgcactatcatcgatatccacatttttaagctgacttcctacacctggaatcatggaaagcaggtctgtaagaccgcccatcttcttaatctgctgcatctgggaaaggaaatcgtcaaagccaaactccgccttgcgaagcttctgttctaactttcttgcttcttcctcatccactgcattctccgccttctcgataagagtaaatacatctcccattccaagaattcggcttgtcatacggtctgggtaaaactgctgtaaatcttcaagtttctcacccatacctacatataatatcggcttacctgttactgcgcggatagaaagtgccgcaccacctctggtatcaccgtcaagcttggttaagatgacgccgtcgatgccaaccttttcttcgaaagttttggctacattgaccgcatcctgtccagtcatagcatctacaactaaaactgtctgtgtcacatcgacattcgcctttatattctgcagctcttccatcatagattcatctacatgaagacgtcctgcagtatccaaaataacaatattgttgtcattctctttggcatgttcaatagaagctttagcaatatctacaggattctgcttatctcccatagtgaacacaggaactccctgtttcgcaccattcacttccaactgcttgattgctgccggacgatatacgtcacaggcaactaataaaggtttcttaccctttttcttgagctgtccggcaatcttggcacaggttgttgtcttaccagcaccctgaagacctgccatcaggaaaacagtaatctcattcccctgcttaatcaccagctctgtcatctcggaacccatcagggattccatctcttcttttacaatctttattaccatctgacctggatttaaaccagtcagaacatcctgtcctatcgctctgtccgttactgtcttgacaaaggacttaactacacggaagttaacatccgcttccagcagggctctctttacctctttcatcgcttcctttacgtcagcttctgtcagacggcccttgcttctcaaattcttaaagacattctgtaatttatcagtaaggctctcaaatgccataacaaaatctccctgttcttaatactcttccagtatgttgctggacagttctgcaatctgtgcaatcttctctcggacaatggacttatcatcacattccgcaatctcttctgcacaggtatgaatggaagctactgtcttctttactttctgaaaatgttctacaagatgaaggcgattctcgtaatcggtaagaatcttctcacatcttttaatcaaatcatatgctccctgtcggctgatgcctcgaagaactgcaatctctgttggagacaaatcattctgaatatactctccatatacctctttctggtgctgcgtgagcagttcaccataaaaatcaaaaagtaatgacttctctactattctatccaatagtctctcacctcatgtcgtgtaaagtagttttgctttacagttggctattatatacgacacaaatatttttgtcaagtacttttccttgcttttttgtgaatttctgatttcctgcaaaccaatggacaaagcactgacgaaactcgaatctcaatatgccctatttgagactttagtcacggcgcgttgaatgcccgcttaaaatgctcgcggccaacttttactccagcagtcactgtcagaagcatcgaaagccaatacctcctatttgtagtctcgaagcaagtgttgggtacgagtgctttaagtgagcatccaacatgccgcgactaaagtcacaaataggaagtattggctttcaatggttcgtcagctttgcctgcgcggcaaattagaaattctcagccttaatctggaagtaagcctgtggatgatcacatacaggacatacatccggagctttctttccgatgcagatatggccacagttagcacactgccaaatggtatctccatctcttgagaatacgatttctttctttacgttatcaagaagttttaaatatcttgcttcatgctctttttcgattgcccctacgccttcaaacttctctgcaatgtcatcaaatccttcttctcttgcttcttttgcaaaagttgcgtacatatctgtccactcatagttctcaccgtctgctgctgcctgaaggttctcaatcgtagaacggatagctcctccttcaagaagtttgaaccacatctttgcatgttctttttcgttgttggctgtctcttcaaaaatgcttgcaatctgaacatagccttctttttttgccttacttgcaaagtatgtgtatttattccttgcctgagattctcctgcaaaagctgtcattaagttctgttctgtttttgttccttttaattctggcataattaacccctttcttctatacaatagtatccatgtataagtaattaccctttgttaccattttgtaataatagtaattgttattgtttatatgataacttattaataaataattgtcaagaagatttttaaaaatatcattcatttttttatttttcatctttatcctttacaatacggtaaataaacatataggcataaattaataacggcagtcctaacatcacaaaaagagatgccataaaatatggactccccgtaaccgcacaatataatgtaacaaaaaccattgctattagaaaaatcaccagcagtaacgccagtattcgttttatctttttcatttttcttctcgttcttctttcttttttacttttttctttctcttctattcttcccgttctcttaaatgtttcagatgcgcttttattttcttttcgtatccattctctgttggaacataaaatctttcttctttcagttcatctggaagatactgctgttttacataatgttccgggtagtcatgagcatatttatacccaataccatgtcctaattttttggctcctccataatgagcatctcttaaatacggcggaacctgacctgtattctgacttcttaccatctctaaagctttatctacggccataatacacgcattgcttttcggtgcactggcaacataagctgctgcctgtgataataaaattcttgcttctggcattccaattcgttctacgccctgcgaagctgccaccgcaacaactaaggcctgcgggtctgcattccctacgtcttcagaagcacatatcataattctccttgcgataaacttcgggtcttctcctgcatcaagcatcctggcaagataaaaaactgctgcatccggatctgtcccacgcatacttttaataaaagcagagatattatcataatgattatccccatctctgtcataattaaccgactttcgctgaatacactcttctgctacagacaaatcaataactagttgtcctttatcatccggctctgtggtgagcacaccaagttctacagcatttaaggctcttctggcatctccgccggccatctcggcaataaaccttgccgcttcttcggtaatcacagctccatatgcacccatacctctttcattatcttctaccgccgtctttaccagacgataaatatcgctctctgccagcggctccagatgaaaaatctgagacctcgaaagaagcgcactatttacttcaaaatacggattctccgttgtcgcaccaatcaaaatcactgtaccatcttccacaaatggtaaaagataatcctgctgtgccttattaaaccgatgtatctcatcaataaataatattgttctctttccatacatcccaaaggcatcttttgcctgtgacaccgcctgttccatatctttctttccagaggtagttgcattcatctgcacgaaattagcacttgttgtatttgcaataactttcgccagtgtggtctttcccgttcccggagggccataaaaaatcaacgagcttatcttatccgccttaatcgcccgatataataacttatcttttcctataatatgctgctgccctgcaacctcatcaagattcttcggacgcattctcacagcaagcggagattcctcttttttcctctgcatactcatatactcaaataaatccatcttttgcctcattccatttctttctcttataaaaatgtattatatcatcgctacatacatggcgtaaataattgcctgataattattgtactattttacaaaagcacttcgttatactttaaatatctctaggaatatcccttacattcaatttccgtataatcgcgtaaccgtcttctaaatccacttcactgtaacatccctgatcaaacacaaaattccagtaaccttctggtgggagtttcaacattgctgccagcaaatgacccaatgttcctttatgtgcggtaatcagcatcttttccgacttattctcttccccagatggaatatctttaagaaaagcttctactcttcttcttacatcaagaaagctttccccttctggaatccgatatgtagaaaattctttattccattgttctaattcctgcggatattttcctttaagttgcttataagtaagaccttcaaaaataccaaaatcctgttccatcagacggctgtccccgaaaatttgctgttttctttcttctattataatctgtgccgtattataggcacgcaccagggggcttgctaccacataatcaaaagaaacctctttaaaaatatgctgtagatattttgcctgctctattccccttacagaaagaaccgcatctgtctttccataatagcagcctttttcattcagcgctgtctctccatgcctgactaaataaagtttcattttgcttcctcaattctatatttctatctattcacaacgtatatttgcctgtcacatcgtgcgtatataaatgtaatggctttttaacacttctattcataacatatgttccactatctgcaaaaactgtttttcatcaacatacctatacactataacccacagcatcaacatgttatcaatatatgcacatttattaatgcatactattattatacgaaaaaagccgctgcaaatcaattcctgcagcggccgtgtcttctgtatcttatccctgtaacttcactacattcgaagcctgcgggcctttctctccctgaacaatgtcaaactctacttcattcccttcttctaacgacttaaagcccggcatattcagtcctgtataatgtacaaagatatctttgccactctcatcctgtataaagccataccccttctgattgttaaaccacttcactgttcccttaaacatcggaatacctccataattaaaaattcctgctttctttctctcaggacatctccattttagcacagcactatatgcaagtcaatatattttctgataattatatattttagacattattttctgattttttatcctattttgcaattttcgactacatttcacttacgaccccctattttataatttccgattacgactatccccataactttcttcacttttatagctttgcattgctatcatcttcacaatcagctccacaatgccgatattcatacaagagccgactcattcgctttattttacgatcaaacagccccagacgatacagactcaagataatcacacctgccagcagcgcgagaatcatccccttcatcccattcaacttatagccagtataaatcaacactaacgttgccatagaatcaagtcccatgctatccgctatcatctttggctgtaaaaactgacgtgctaccagacaaaccacataaaggataataagaaacattgcctggcgataatccctctgtacaaagcagaacaacgtccacggaatcaatatcgtacctgttccaagaataggtagcaaatcaacaaacgaaattactaaagcaagcagtaatgcatacggattacccatcaggaaaaatcctgccagcaaaatcacaaacacaatgcacataatcttaaactgagcaaggagaaatccacccaatgctgcaattactttatctttaatatcgcgaactgtagacttcaagtcttctggaacaattctccagaatccttccgtaagccgctctctatctgcaatgaaaaagtatgcagaaataatcataacaacagttccaataaaaccattcgtcaaatccgctgcagcagaccccatcatctcaactccctttggagcaaacttattaataattccacccatctggcttaaaaagtctgtaaaaaatccctgtatctgctttccaaaatcagaagaaatcggcgaaacaatattggtaaggctatctccaaaagacttaattgttctctgcacataaacatagtattctggcgctcctgaaaacaatcccatcagctcccgtccaagctttgtcactgccagataaccgattcccgccagtgccagcaaaacaagtacaatgattaccgctgaagaccattttttgttcagcttaatatgtttctctaaaaaattacacagcggtgttgccagtaatgccagtatccagctcgctacaaaaggccagaaaaatcccattaactttggaattcctataatcaacagcacagctatgccaaaaaatataactgtttccataattatattaaataatatcttccactttttcattccagacacccgctctctagtaaaatatataaatataagtatagcacagccttatgtattttcaatgaattatacctttaaacaatttcacgttcttttcccctcggaacaatcacactttgggagtatctttcatttttcctccaccggagcagttatactttttagaccatctttcattttttcttcactagagcgtgtttgaaaaatactttcagactatctttcgttcctttcctaccggaacaatctgattttttcttctattatagtaatataccgaatccgataaaatatcccccagcgcaacaacagtattatttgcatctgacaccattgtaaaaagcgcagacggatcatcaatcttattcgacggcactaagattacctcatgtatactgcttggcagaatataaaaatccgttttcttttcgagggcgaaagactctaaaacattatcatataaaagaacagacgccccattcacttcctgttcattcgtcataatatacatcggaatcgcagactcatccagcgaaataggaatccccgcctgcgctatcatttcatccatatcaatcatatgtacaggaaatagccttggtgtattctctcttgccgccagtaagagttcattcattgaaataccccagacctgaagttcctgattcgtaaccaaagccgtggaaatcccgatatcatcgctatgcgccacccaccgaaaagtcagtgccagatcatataagcgcaaatgagggcaatcctctaatatctccttattcttctcataattcaccagacggtatacaattctgtctctcacatactcaaacttctccaaattaaaatgataatccgccaccctggatatcttccactcatattcttcccggattcttgtgataatctcctctaatgcttctccctttaaataataagaataatattcatccagataaatcgtcggagaaatctgttcttcctcccgcctgatatacagcccacacaactcaattccattattcttcctcaccacagccatctctatatctgcatcttctctccatcccttcaaaacattctcctttatgtatgactgaaatgcctcaaatgtcatattttcttctccttttccataatattctttaatttgtttattatggaaataattgtagcacatattgtaatatttttccagtctttttttgttttatttttacaaaataagtatttttttcttttctcattagatatcttctctatatctctgcccgaaaatactcaatcacatttcattcactccaaatccccatatgtccaatatctaaagatttttttctttaccaaacaaaataaaacaaatttacatactcaaactaccaacttctacactagagcgtgtttgaaaaatgctctagcataatcttccacacaacctcacgatgaatcctcaaatcctccccacaccgaatattaatcccagtctcagccaaaggcaaaaaaatccccctctaaccacctctagacttagagccgctgtttctcacctcacattcacagcaactaaagccatagacaccgttataggggcttttcattttcctctgttaagccaattaatattccataatcttattatcttttgtatagcgatatacttttcccgtatctttatctacataataatctcctgtctttttgcccccttctgactcatacacatggaactgatatccttctgctcccggattaccactgtcataagaagtaagatcctgcgtttcctcccggaattcataggacatatcttcattatctgctgtcagtttatccataagataatttttagcatcttcatacgtgtcaaatgttcctgctcctaagttatccattattccatccgcatcttcttctatattatcttccgcatctgtagattccgtcgttttcttatctttcgtcgtattatctggattttccacactccatccggttgttgcctccgcattatcttttgaatttttcattccacaaccggcaagtgataaaattaccagcgccgccaacaacattgctacataagttttttgttttttcatgacaaaactccttccattgattttaaaagtattatctgcattttttcaaaaaatataattttttctttcccttttcataaatttatagaaaacggttatactgataaaaccaaacgcagaaaggagtttatttattatgaaatggattgactataccgcactgactctggctattatcggagctattgtatgggattgattgggatattccagtttaatcttgtctccttcttttttggagaaaatagctggttttccagactcatttatgacctcgtcggcttatccggtttatatttacttaccttgtttggccgaatcggacgcgatatgtaagcatatgtattttgttccctctattttatactctgacaatatttatattttagggtgtgtttaaaagaatcattcctgtaatctacagattctgacaaaacaggcagcaaagaagtgcaaatttgtgtaaacgaatttctttacaacttctttactgcctcttttctttttgatatactaaattcaatcataacacaaaaatatactctcgaaatctttttgtgcttgattttgtgagaagattttttgtcagttgtgtccaaatttttgaggtatacgcggtgcggctggcggaaaatcagccacaaaagcaagtgcaagaaagactccgagagtacataaaataacacgggaggaattttatgaacttaaaaaagaaattatggcgattgttatctgttctttctactttattactcgtcattcttccaatttccggatgtgactattttttcagcgcggaaagtaacaccgagacagggacttacactaccctttcagaaactacagactacacctccgattctgccactgaacagaataagacgagtaacatagaaagtggaaatacatctacgaccgagaaaaaacagattgacgaaactgacggttatcttgataaagatggcagctacacttccaaagaagatatcatgaattatctcatcgaatacggacagcttccaaataattttattacaaaaaaggaagccaagaaacttggatggtccggaggcagtttagaaccttacgccccaggcaaatgtattggcggagattattttggcaactatgaaaaagttctccctgttgtttccggcagaacttaccacgaatgtgatattgatacactcaacgccaaaagccgtggtgccaaacgaatcatttactctgatgacgggcagatttactacacagacaatcactataaatctttcactttactttatggggatgatgtacaatgataattacaatcgatggtttagccatgaaaaagaaagaagatttttatcagaacataaaagaggaacttgatgttcctgaatattttggaaataatctggatgccctatatgattttttaacagagcagccagacattttacagatgaagtttcttcattataatatgatgcaaagccagcttggcagatctttttgccaacaacttctaaaagtattacaggatgccgacatcctcaccataatagatgagtattaggacaatcgtaataaattctaatacagggagcaccgtaagggtgctctccttccacttataaaagtttatacttaatttttctattccagcgagaataatattttccccatttttaagcagggtaagcggtgcagaaaaaacttctgccgacaacacaaacggaagaatgattgccatcgcaagataaatccatacccaccccgatggaacattttttatcaggttccctgttatgcctgaaaaagtaagcacatataaaatcaggcgatgccagaaatatatttgcagtgttcttgctccaactttccctactactggcactttacagttcggtatcagacttataattgcaattcccatcaaaaatgcaattacataaaacataagcctatgtactgctccacaactttctacattaataagcgagtaagcatttcttcccgtaaaaagccgaatatacgaatagttatcttcaatctttgctaatgtatataaaatcatatctgtaagaaaaattgctgacagacactttatccaggttttgtttaacacttcctgcagcttctttatatccagacaatatcctgtataatagaatgggaaaaatacaataattcttgaaagatacaggaaacttcctatattttcatcatatccggcaaggcatgccgccaaaatacttatcggcaacacaaaccataacggaagttctttaatcagatacgcaataaccataaatgcagccatcgcaaacatataccacggaatccccgtatcttcaaaccactgaaaaactgctttctgatggaacaaaattttaattccataaatgcaaaccttcagtgcatatcctatcataatataatataacggtttgtcccattgaaacttacatcgctgtgaccatcttttttgtaataatccggacaaaaaaataaaaagcggcatatggaaagaatatataaaaagagaaagactcttcattgtattcgatatcggggcatattgatttacaaaatgtccaataacaaccataacaattaaaaaacacttcagattgtcccacttataaatgcgctttgtgctttttttcactgcttcactcatcttaatacctctttgtatcaaatatttgcatctgattatagcacctgatttcaaatttttctatagtaaaatttaacactttagaaacctttttgtaacatttattttggcattttgcttagataaataagaatttgccgcaggcaaaacagatactctcaaagagagcacatactctatatttgtgttctgggagctgcaagactataataaaaaatattagaaaagcctaataaccgctatatcagtagtcattaggcttttgtcatgcggataacaggaatcgaacctgcactccgaagaactagatcctaagtctagcgcgtctgccagttccgccatatccgcatatcctgtaattcaattatcttttttcacaagcgaaaaaagaaagcgggtgatgggaatcgaacccacgtatctagcttggaaggctagtgttctaccattgaactacacccgcaaatatcggggtgacaggattcgaacctgcggcctcttgatcccaaatcaagcgctctagccaagctgagccacaccccggtatactatataatatttttcgaaatcaaaaaccgctatagcaacgattttcgaatgagacatcggggattcgaaccccggacaacttgattaaaagtcaagtgctctaccaactgagctaatatcccatatcaaattattgatgagccagcttttcgaatcactggtcctactggactagctggattcgaaccagcgaatgcaggagtcaaagtcctgtgccttaccgcttggcgatagcccattataaggtgggtagagggattcgaaccctcggcctccagagccacaatctggcgcgctaaccaactgcgccacacccaccatagccaggacaacctgacaaacgtgcccgaagggattcgaacccccgacccacggcttagaaggccgttgctctatccagctgagctacggacacgcataaatagttagatacaatatataattgtaaattccactttcgcagaagcgggtgatgggaatcgaacccacgtatctagcttggaaggctagtgttctaccattgaactacacccgcaagtatcggggtgacaggattcgaacctgcggcctcttgatcccaaatcaagcgctctagccaagctgagccacaccccgatatattgttttctttgtctttgctactctctcgcgctgacaatatgcattatataccacaccaaagaaaatgtcaacagtttttttcaactttttttaatttttttaataatatatttttttcagacaattaattcaactaaccgcttattttatgacattttaaaatttgtcttttttcaatctctctcatgaaatatttctgcaaaatagttttccaacaacctttctcattgcttacaagctgactggagtgtgttaaaggtagttaatttccacctgtgattaatttctgcccgtgacaaaagcagaatttatttataaaaaataaaataaccgacgtaactttaagctgtcacgccggccacttactctgaatcaatctgattcctatttttcttctgttgcttcttcagattttttctcttcttctgttttggcagcttcttcctctgctgtttcttctacttcatcatcttcatcaaaaaaatcatcatcgaaatcgtcatagtcatcatcaatatcttctaaataatctggagaaagatatttgtaaactaccgctgcgattcctgcgactgctgcaactgctccgataattgccagaacccataaaacttttttggattcatcttttttatcattgctcattaattctgataactttgcaacaccgagtaattcatcaatattcttcattgtgcaatcctccttattaattttgtctttagtatatcacgagacggagaactttaccaataaaatattttttaaataccaatttgccgcaggcagcgggctgtcttccctgcctacgggcaaattattttacctttttaagttttgcgaaagaagcaaacatcttcttccttccgactctgtcaaactccaccgctacttcaaagtctctgccgccttttgtgatttcctgtacggttcccacgccaaatttgatatgttttacgcggtcacctacctgatagtctaattctcctactggttttactttaaagtcgcttaaattatatggtttgcccgctttggctccatactggtattttgcaggacgttctgtgttcttgacaacacgctgttcggaaacacgctgttctgtatcaagatactgtcctgggatttcatcgataaagcgggaacggcggttgtactgtgtctggcctcgaagcattctgcgttttgctgcacttaagaataatctttcttttgctctggtgatgcctacataacaaagccgacgctcttcttctatttcagattcgtctcctgacatcatggctccaaagcctggaaaaactccttcttccattccgccgagaaaaacattattaaattccaatccttttgcattatgaagggtcattaaaagtactttattattttcatcttccaagttatcaattcctgcatttaaggtatacatatctttttctgcgaggaaatcacgaaggttcggattctcctcctcttcttcataataggcaatgtcattgaaaagttcttcgatatcttccagtctgcttattgattcatctgtcccctctgcttctaattctgctctgtactgtgtcacgtcaaggatatgctctaaaagctcactgatttcatgctcgctggcatattcgcggaattcttctatcatatctgcaaatttatgaagctttgcgagtgcacgtgtcacttctggaatttcatctgcattaaatactgcatctaagaaactcatctgattcaaaattgcaaattcctgcagacggttaatcgttgtctgtccaatgcctcgttttggcacatttataattcttttcacagagaggtcatccattccactatctactacttttaagtagctcatcaggtctttgatttcttttctatcatagaaactgataccacgcacaattgcatatggaatatttttctgctttaacttttcctcaaaaatacgggactgggcgtttgttctatataaaatagccatatctttatactgtactccccgcatcgcaaggaaattaatccttgataccacaccgtctgcttcgtcgtattcagtatcatactgcttaaaatgaaccagctctcctttttgattctctgtccacagcttcttttcttttcttcctttattgttcgctatcacaccattagctgcatttaaaatattctgcgtagaacggtaattctgctctaaacgaataacctgtgcatccggaaatactttttcaaagtttaaaatattataaatattcgctcctctgaacttgtaaatggactggtcatcatccccgacaacacaaagatttctgtattttttggcgagaagacttactaacaggaactgtaccgtattggtatcctgatactcatccaccatgatatactggaatctgtcctgataatgctctaacacatctggattggtctgaaataaatctaccatttttacaagcaaatcatcaaaatccaatgcattattctctttgaggcgtttctgataatgctcataaatatctgcaatcctctgattacggaaattgcttccatattcattccgatagtcaagcggggacttgtattcattttttgcagaagaaatctcagacatgaccgagcgttccagaaactgctttgtatcaatcttcatctcttttaaaacttccttcatcagagacttctgatcgctcgcatcgtaaatcgtaaagtttctatcataccctaataagtcgatatgtcttcgtaaaatacggctgcaagtcgcatggaacgtactaatccaaatatcttcggaaccgtagcctactaatgcatctactctttccctcatctcctgcgctgctttattggtaaaagtaatcgccaaaatgttccacggtgcgactcctttttcttctattaaatatgcgatgcggtgtgtcagagatctggtctttcctgaacccgctcccgcaagcattaaaagggggccttctgtacaaaataccgcctctctttgttcattatttaaagtatcataaatactcattattcaacctttccaaactaaagcgtgtttgaaaaatactttcagcaagatgtacgtcacaatttacagacgattccacccaaataaaggcgaaatatatacagtaaaatgatgcgtgcaataagttgctttctaatttttcaaacacgctctggctataaatcaaattctgtaattaattaaaatgtctaaaacacgctctatactaacttctggccacaattcggacagaacttgcttccctctgtcttctgaccacagtttggacagaagttcggtattgtaccagaagcctgtcctgccgcctgattctgtggtgccggagctgcattctgtacctgtccctgcatattctgattattttgctgcatggcactttgcatctggttcaccatctgctgccccatcatcattcccatctgcatggaggccatatctgttgccatattattgccgccgccattattgcttgtattcgtcatggcatcaatcatcgccatctgctggtatcttcccatatcgccaaccatactctgacttgctaccttcgttaccatcttctgtacttcttctggataacttacagaatcaatctggaaactggttgcagcaagaccaatcttctgcatctctgtattcagttctcctaagattccctgagaaatctccactgcatttgcctgaatgttaaacatatcctttccctcgcggacaatccagcgaagaagaagctggttaagcatggataatacacgttctcttacttcatcggttgtatactgcttcttgacaccagccaccttgtcaataagcatctgataatctcctaccttaaactggaatgttccgttcgcacgaatcggcattccccctggcagagcctctgtcggcagattcacagcctgtttcgttccccacttcatcgtaaattccttcgtattgatgaaaatgacttccgcacgaattccactgttaaatccaaacttaaatccctttagtgtagagaggaatggaatgatatctgattctatatcataatttccttctttttcaaaaacaccttctgtaacaccattgtataaaaaaatagcgtcctggcccggacggataatcaaacgggagccctttttaatctcactgttattccatttatagaaaataacgtcatctctgtattcttcccattctactacattggcaagctgacttttgaataatcccataataaacctccttgcacttatgtacaatctgattcgaaagtacatctctattatatattttatatccgctgtcaaatgacagatatatatttttattataccttactttcccattcttgtcacttatgagatagattttatttttcctgatattttcccttgctatatagtaataaaaactatataatatagttacataaacatttgtatatatacttcagagcatgtttaaaaatactctggagcacatcaaatatatggaggtaccattttggataattataaagactggctgtacgccttattaaaaacagaaccgattcctccggaagacattccagacatcggattatatatggatcaggtaacaacattaatggataccagattagctgcttctaagagatatcctgacgataagattctgacaaaaacaatgatcaataactacacgaagaatcatctgctccccccttctgacaagaagaaatattccagagaacacgtctttcttctcattatgatttattatctaaagagcatgttatcaatttcagatatccagagcctgttagaacctctctccgagaagtattttccaaagaatgaggaaaatggtctgaccctctctgatatttaccagaaaatcattgacgataacaccgctaatgaagaatacatttcagaagacattataaaaacatgggaacgaactcgtaattcttttgcagagcattcgccttccaccgaagaatcagaatatcttgatgatttttcttttatctaccagcttggatatgatatttatatccgaaaacagattatcgaaaaactcattgataagagaagagaagaaaatcctcctaagaagaaagggtcgaaaaagaaatagcactatcctcctaaaaataatccatatctgcggcctcggagctgcgattatacaacattggtaacagtatctcattaaaatacttgattttgcgactttgtgttttttacgacggagtcaaaatcaattattttaatgagatactgtttgcagatacctattcgcagcgactaaagtcacagatatgaattattttgcttgcaggattcgtctgtcttccgccaaacactctcagctatttatcctcctccatacgtcccagcaccaattgatacccgtctgttccatagttcaggcagcgatttactctgctgattgtcgcagtagaggctcctgttgcttcggctacttcgttataagtcttatgattgcgaagcatgttggctacttcaaagcgctgtcctaaggataatagttcattgactgtgcataaatcttcaaagaaagcataacattcgtctacggactgcagctttaaaatgccttccattaactttttagtttcttcgttatgtacacttttccccataagtttcacctcttcctttaaaacttttattgtcttaattgacttttctgtaattatttttcctcgtaattacatttcgttttccataattattttaattttttcgcacttatttttcctcatattttcggtgaatgtattctttaaatacatcgacagaacggtttacaatcaattcttctggaaaatcaatttcttttatgagtttttctgaaaaatctcttcttgctacatcgcaaaatacgtgggaatcactgttcatgataactggctgtttatattccttacacagctctaacattgcaatcaaattctctctggtgtgttttctggaaccggcagggtttaaagagttgttatttacttcaagaagtgtgttcgtttcctttgctgcttccacgattggttcatattcaagaggatagattccatcatccggatgtccgataatatctactaacggattatgaactgctcctaaaaccgcctgtgtattctcttttcttgttcctggctggatacaaacactgtgcaggcttgcgattttaaggtctaactgctttaatacacgggtatctaaatctatatgtccgtcataatctaaaatattaagttctgcaccaagcattaattcgataccgcacattgttcttggaactacctttaagttatgaaaatacattgcgtggcaggtacccggcatcattggtgcatgttctgtaattccaagtaattttaatcctttatcaaaccctgcctttgccatctccatgatggtgttatatgcatggccgctggcaattgtgtgggtatgtacatctaataaatagtccattttgcctccattttattatcatgtactctcggagtctttcttgcgcttgcttttgtggctgattttccgccagctgcacccaattttcaacaacgtatgcctcaaaaattcgggcacaactgacaaaaatcttctcacaaaatcaagcacaaaaagattccgagaatacagtatcttgacaggttcccgaaaaaccgggaacctcactcatacattaacgtaataaatcatcacagtttcatagtatatcatattttcaaaaatttttatagtcaaatttcccgatatgtgttttctaacgtttcacaggaagaatgcagccgttgtttttcctcacttcctaatggaagttctacaatccgctggattcccattcggtttacaacacatggaattccgatataaattccattttccccgtattctccctgcaaatgtgcagatacggtaagaacactgtattcatttccaaaaattgcttttgtaatccgtgccattgccataccgattccataatacgttgcctttttggcctcgataattttataggctgccatacgtacttcttcctctaattcaaggagttcctgaaaatgacacccttctgtctccccacacaaatcaaaaatgggcttagtagtcatcatcgcctggctccacggaacaaattcgctatctccgtgttctcccataacgtaagcatgcatatttcttgggtctatcataaacttttctccaagaagatatcgaagtcttgccgtgtcaagtgctgttcctgtaccaatcactttttctggcgggaaatcactgatttcatatacaatccttgtcataatatctaccggatttgttgcaacaagaaaaatgccgtgaaatccattttccagtacagattgaagaattgtctcaaatattttcctgttttcctttaataaatcaagcctgttctgcccttctttttgcggaaggcctgctgtcagcacaacaagatctgcattgcagcaatctgtatattctcccgcatagatttccatatttccaccgctaaatgctaccccgtggtttaagtccatcgcctcgccctcagctctttttttattaatatcaataaggacaagctcatcacataaattctggtttaacagtgcataggcatagctcattcccaccattccagttccaataagaactatctttcttttatctgctttttccataaaaaaatacctccttaccggaggtattctctgctgtttttaaggaaaatatacaaaactttttaatttgcctcataaggacgtacacggagatgaagtccatgtgtatcacacactttctggcaggctgcgacttcttcctcgccaatcacatcaacaacggtcattactacatttggcacataacgctgacaggcctttgcaaagctgagcattgcatcgtaagaagcgagtccaaagcggtttctcgtcacatcaagatacttctgtgcagtagaagaatttaagctgatggaaacagtatcaaaaattccggcaaggcgacttgcagtcggctcaccaaagactaaatcagacagaccattggtattaatacgcagaggaatatctggatggatgctctttaaccactgtcctacttctactacatcattaaaacgcatcgtaggctcaccgaaaccacagaaaataatctctgcaactttagaccagtcatacttggaaaataattcttttactaattctacagaaggttcttccttaagccacaagctgttatgctcgttaaattcctttaaacttcttaaacaaaatgtacaggaacaggagcatctgtttgtcatgttaatataaatcttattcggaaatccgttctccccaagatcagataaatcctctttaaagtcctctaagttatagtaaacaccatttttcactgtatataaaatcatcgctaaatctcctctaaatattcttcaaaacatattccgtagttccacggcagttccatctgtgccgtataagcaatcgctttatcaagaaatgtgactgctctttttactgctgttttaaaatcctgtccctgaatcaaagcccctgttacaatagaagaaaatacatcgcctgttcccgaacggtctccgccgatttttcttgttgataataattctgaagtcttatttttctcaaaaatataattaaatatcaaatcaccttgctgtaagcctgtgatcacaattctacttggccccatatcgcttaaagcctcacaaatcgctacaagtccctcttctgacaaatctactttgtgataatccaaatcaagaatgcgacaggcttccgtaagattcggggtaagcacatccgcatatgggagaagttttttcatttcctggcacatatcatctgtataagatgaataaagctttccgtaatctcccataaccggatcaacaaccgctaatgtattctcctttttaaaccgtttaaaaaattcaataacaagccctatctgttctttcgacccgataaagcccgttgtaattccatcaaattcaatacctgtctcttcccagctattcatatatgtcctaagatatggtgtataatcctgtaaaaaatagtttggaaatcccgtgtgtacagacaggattgctgtcggcatcacgcagcactgtatcttcatcgcggaaatgattggctgtgccacagcagcagaacatctgccaaatccggtcacatcattaattaccgctactcttttctgtcgtttcatattgcctccaaatctttattatacttgttattcttttctctttctcaatcatatttttcaaaaaaatatactaacaagttctgaaatacttcccacaaaatatttcttataaaatatcatttataaaatatttactgtgaaactttctataacgtatataattccggggttaatctcccgtcatccgctaaatctataattaaaaatgtaggtcctgccggtgtcatctgtcttggcagtgcaatacttcccggattaaatacagtcacgccctctttttcatagtaatgaaaagccggacaatgtgtgtgtccataaaaaacaacatccgctcccatctcctgagccttacttacaagttcttcttctccccagctcacaccataggcatccccatgcgttacaaatgcaacatgatcgccaagttcaaaaatatcttctttatcccggctaaaattataatcacaattgccttctgccatataaaccggacatcctgccaattcctctaacatttccggcggaatctccatatctccgcaatgaatgagagcctcaatctttccacggaatctttcaatcacatactcaagattcgacatatttccatgattatcactaaccactaaatacttctgtcccatactcgccatccttccctctactcttgcttattcctgttatttattcactttacttattcattttctttctatattatataattcattttcattaaagcgaattaaatgataccacatccctcgccacctttcaacggaaatgtacaaattaggtactgtttatgcataatcccacttgatttcgtaaagaaaagaaactatactattttaaagacaaatgaaaatatgtactttctgaatcttcttgtgcttgattttgtaagaagattttttattagttttgttcattttttgagctatacaggatgcctgcattaatgcatccgaatataactaattaagaatacaccaaaaaatcaaatccagaaaatgattcagggaatacataaatataatcaggaggaacatagatttatgaaccaactatccgacccgattgcggtatttgactctggcatgggcggcatcagtgttttaagagagatgacaaagctgatgccaaatgaagattttatttattacggtgattccaaacatgccccttatggaacaaaaactctcgaggaagtgcgcacgcttacgattgaacatattacatatcttattaaggaaaaacatgcaaaggccgttgctgttgcctgcaacactgcaaccagtgccgcagtacgaattcttcgggatatgtatcccgacctacctttagttggtgtagaaccagctatcaaaccagcagtattagccacaggacatgcaaaagttgttgtcatggctacaccgatgacattacgcgaagagaaatttcacaaattagaaagtctttacgatgaacaggcagacatttatccactgccttgtccaggccttatggaatttgttgaacagggtattttatctggcgaaaaacttgaaacctttctccataacctgcttgacccatataaggataaagatattaccggcattgttcttggctgcacccactatccgttcctgaaagaaacgattcagaaaatagcaggcccgtccgtcacgatctttgatggcggctatggaacggcgaaggagctgctccgccggcttagggtggcagatttggcgcaggttgacaatacgcgaaaaggcagcgtcacttttttaaatagttctgatgatccggcgttgattcagcggtcgaaaaagttgctgaattcctgattttctacgcaaaacacagccctctaagaatgaaataatccttatttcattcttagagggtgtctcccttgcctgcggcaatccaaaatttattccgaaaactctgttgttactaaagtctcataatccacacgtttttcaagttcccctgcttcttctaatatatcctgaatcaaggtgaaactttctttttcaaattttgtattttctttatagctatcctgttcagcataacgttctacgattttttcgagtgtttttctatctgtgtctttaaattgtggtgcgattactttggctatctgcgctggtgtgtgggtgttgacatactcctggcctttttcgatagcacgggtaaaagcttctaataattccttgtgggtttcgagatagcttttctttacactataagccgtgtaaggaacatagccgctctcttttcctacggaggcaacgacataaccggctccctgttcttcaattaaggttgctgccggctcgaactcaaccgtgtaatcagcctctcccgagacaaatgctcctgacgtattggcaaaatcaatgttttgtacaaggttaatgtctttttgtggattcattccatgtttctttaaaacgtattcaaataccatttctggcataccacctggtcttccaccaatgacttttttcccctttaagtcttcccatttaaaactatcctcttttttacggctcacaacaaagttaccggcccgctgtgttaattgggcaaagtttatcagatagtctgcattgccctggttaaactgatagattgtcgcttctggccccataaatgcaatatctgcatctccgcttattacagccgttgccgtcttatctgcaccaaacccggtagtaagctccagtttaattccttctttttcaaaatatcctttttcaatcgctacatactgcggggcataaaaaatagaatgtgctacctcatttaaacgtacttttttcaaatgatgacggcttccctcacagcctgccagacagcaaataccaaacagcatgacaaaacatggcatcattaatattatgagatatcttcgcatggctaatactcctgttttattctacaacagtatattcgatgaaaaacaaaatgtgaaaattctgatttgtgaggctgcggagcagacgaactcctgaagcgaaataaagcatattggtgactttagtcgcggcggtttgaatgttcacttacagcgttcacatccaaaccttgctccgaggccacaaatatgctttatttatcttcatgagttctgcttgttgacagctcagaaaatcagttggagagatttggggaagaggacaggagatgtagaagttctgggaaatgaaattctataggattgacacttgaatcagtgccataatcgtatagttatttatggtcactatttttttctattaactagagcgtgtttatgaatttattttttgaaaaaaacaaagtaatttgtgctaaaaatactaaagaaagcaaaaaagttataaggcgaatggataacgcccagaaatcttccaaagatagttataataccaaataatttaaaatgataagataagtgtcagtcctccagcatttcaattcctcaaaaggtcacaactgtctgaagcctccctcaaatctttctcaaaataaatcctgaatttgcatgggcagccaacaaacagcttccaaagagagccgattccctatatttgtggcctcggagcaaaggttggatgcaagcggttaagcgaacattcaacctgcagcgactaaagtcacaaatataggggatcggctctctttggaagcgtctattttgcctgcggcaaatcaggagttaaactattcttcttcttcccagttatggtatactgcctgtacatcatcatcttcatcgagtaagtctaatgtacggtttaagttcttaatatcttctgggtctgttaatgttacatagttgtctggaatcattgttacttctgcagatgccattggtacgccttctttttcaagggcttctcttacttcaccaaatgcgtctgggtctgtagtaatttcgtagctgtcatcttcttccacgaagtcttctgctccggcatctaatgcaaccatcataaattcatctggatctgtttcgtattcttctttagatacaatgatctgtccttttttctggaacatgaaagatacacagccggatgtaccgatatttccacgtcctttggagaatgcggaacgtacgttagctgctgtacggttcttattatctgttaatgtttctacgataatagcgattccgttagggccgtatccttcgtatgtattctgtacataatttacggagttggcatctccggcagcttttttgatacctctttcgatagtatcgttaggcatgttgttagattttgctttagcgattacatcacgaagcttactgttattcgctggatctggaccgccttcttttactgctactgcaatttcacgaccgattacagtaaagattttaccttttgcagcatcatttttttcttttttgtgtttaatgttcgcaaacttggaatgtcctgacattttatcttctcctcacttctctatgatatttaaatactcttataggcataacttttttaagtttatcaccgttttattatgtagtcaagtattctggctttatctttctgatttacctttccacaaaaattttcgatttacacccatttttttattttttatattttcataaaaaggctactgtgctggcatattgacaaacatgctattttataatctgtacaatattctccaaaatcagctactgtaccagagcgtgttaatgaatataccgaaatcttttttcaattattttaatattccagactcttttatgctcgcaattgctttcttaatctcttctggcggaagtacgagagcaaaacggacataaccttcaccaaggcttccaaaactgcttcctggtgtacagatcacgccagttttctccataagttccataacaaattcattggaattcgtatagccgtccggcagtggcccccatgcaaacatagttccctcgctgtctggaatgttccacccaatctctcgaagtccttcgcacagtgcatctcttctttcctgatattttttgcactgttcctgtacggcagcatcatcggattttaatgccgctactgcacctgcctgtacaggaagaaatataccatagtcaatctgggaacggaaacgtttgaacacttcaatgacctgtgcatttccaatgacaaaggacatacgcgcacctgtataattatagctctttgacagggaataaaattctacgccgacttcctttgctcccttgaaagaaaggaaagacttgccttctcttccgtcataaataatatctgagtatgcattatcatgaatgattaaaatattattttccctggcaaatgtaattaacttttcgtagaattcgtctggtgctgtcttacagattggattggctggataggatactaccatcacttttgctgccttttttacatccgcaggaatggcatcaaagtctggaagatagttattctcctctgtcagcggataaaaccactgattactctgtgcgataaatgcgcctgttgaaaagattggatatcctgggtttggtaaaagcacgatatctcccggattaatgagtggcaggaaaatgtgtgccattccttcctgagagccgtatacagacataatctcattcttcgcaatgtccgtattatatctatttttgtaacgtgctgctaacgcatctaaaagctcatcggtctcgcctaaagaataatgataattctccgggtgaaggcaggcttcggataccgctttcatcacacattccggtgtttcaaaatctggtgttcctacagaaaagttgtaaatcttctttccctgtttttgcaattctttctttttctcatctaaaatctgaaaaattcctgcttcaaaattcttcattttctctgctggttcaaaattcatatttttattactcctttgtgttgtcctttatgtaatcagctccagactgatttttaaggcatagtttactctctttaaggtgtttgtgtcaagatggcatacccgttcttttagacgctgtttgtcaattgtacgaatctgttctaatagtacaaccgaatcctttgtaatatcacactccgtcgtagacagttccacatgagtcggcagttttgctttattcatccggcttgtgatcgccgcacagattacggtagggctgtgacggttgcctgcatcattttgaataataagcaccggacggacacctccctgctcggaacctacgaccgggcgaaggtctgcataataaatatctccacgttttatcatcattttcactcactccattttacttttctttctaaatgaagtatttccagcaaacgtcatgagtattctgatgatttcctttgttttttatatttcttctggaaaatgtttccgcttcaaaatagtttcgagataattcggtaaatctccggcaagaacactataatatcccttttcttttgcggcagcatctccggcaagaccgtgacagtacacaccaagtcgtgccgctgtcaaaatgtcaagtcctccggcaagaaaaccgcagataattcctgttaatacatcgccgcttccaccagttgccattccattgtttccgctcatattaatgtatgaaggtacgcttccatcggacacaatggttcttgcatcttttagcacgataacatgtcccttatctgcagtacttgcagccgcttttggcagattgctgcgaatttctgcaatttcttctccagttaatctggacatttctttcaaatgcggggtaagaatcatcccgccttcatattcatgaaatagctgccttaattctgtatcttcttgtaacaaagccgccagattattaagcccatctgcgtcaataacaagcggtgcctttcctaatgtaagaacctgttttactaacttacttgcaaatgcactctgtccaattcccggtccgattccgataacagatgcccacgaaagagattccggtaatagttcccatgccttttcttccgaatcataagtcgtaagaatcgcctctggaagcttttcctgcaaaatcacacgattctcctcacaggaaaaaatgcgtaccagaccgcttccgctcttataggccgctgttccactcaaaagggcggcccctgccatatttttggagccggcaatcagaagaaccttcccgtaacttcctttattcgtccatgcctttctttccggcaaaagttccaggtcatctgttgtgaaagaaaccatctgcggggcgatttcttcaaccgccttattcggaaaaccgatttcctttacaatgacttcgccgctgacatctgcccctggataaagaagcagtcccaccttaggaagcccaaaagtgaccgttatatccgcctcaaatgcaataccaagaatctgtccggcagaggcatcgactccagacggaacatctaccgcaaccttcagtgcttccatctgattcaggcgctcaataacctccctgtgccgtcctgccacttctcgctttaatccaacgccaaaaatggcatctacgataacatcatactcctcatcgggaaacttcatcaaaaaatctgcttccatctgctctaaaatgtgtttctgaatctgatgggaatctgaatcatgtggaatgactccgatttcataaaaatctacggtatagccttcttctaacagaagtcttcccagcgccagtccatcacctccattattccctttttctgtaacaatcagcaccctgctatctgtcggtattctctccaaaaagacttcctctaatgcaagtgctgccttttccatcaaaacgatacctggaatccctacgttatttatactatacgcatcaatattttgcatttcttcccttgaagcaacgtaacgcattatttaacctcctactttctaacaactatccctttcttattctaagatacagaatgcagcatattgttgaactgcatcgttccagaacatatttgaaaaatactttcagcaagctttgcatcaccatctgtatgcaaacaccctttagcaaaaagagatgaaaatctgtttcttacaacacagcttctcatctcttcgttctcttctgcaatataaactttatacttactgattgtgactgtggattcgataagacaatgtcataatactctctgcaagatgtacattctctaccagaatctcttctggaaaatgcaaatctaccggcgcaaagttccataatgccttgattcccaaatcaactaactgttctgcaactttcgttgccttcgacttcggcaatgtcaatgcggcaatcattacctcatgttcttttaagaatgtttccagcatgtcgatatcatatacttccacgccccgcactgtcataccaattaatcttggattcacatcgaaaagcccgataatcttaaatccattactgtcaaaatcctgattgttcgccaacgcctgtccaagattacctgcacctacgataatgatattattcgtcttatccagtccaagaatcttgcccatctcattataaagatactctacattataaccatatccctgttgaccaaacccgccaaaattatttaaatcctgacgaatctgggaagcagtgacgttcattctctgactcagttccttagaggaaatacgaacaacattattcttcagtaaatctccaagataccgatagtaccggggcaatctttttatcactgccggagaaatagacttttcacttcctgattttacaactgttttactatctggcataagttcctccctttgataaaaaattcccattcttaagctctaatgaatcaattatatacaaaaattcttttaatgtcaaataagattgttaaaaattataacacttatttacttattttttctttcatgataaaatacatcagaaatatttctactttataataatgcaacaacaatataactaatttggaggttattatgattttagcctgtcagaaaatcgaaaaagcattcggcggcaaatccgtattaaataatgttaattttttaattaatgaaggggaaaaagcagcagttatcggtattaacggtgccggaaaaactaccctttttaaaatcattactggagaatatgaggcagacaacggagaagttattttccagaaaggctctacctacggttatttatctcaggttattgatgtaagctctcatcgcagtatttatgaagagatgctcgatgccaaaaaagagattatcgagatggaaaaaaagattcgccagcttgaaaaggacatcagtaccttatccggtgaagcattagaaagtgcaatggaaagctattcccgcctgacagaccgttttgaaaaagcaaacggctatgcctggaaaagtgaaatcactggcgtattaaagggacttggatttgatgaaagccagtttgccacaccaatccatacactttccggtggtcagaaaacccgtgtcgcattaagccgtattctcttaatgcacccggatctgattttactcgatgagccgaccaaccaccttgatatggaatccattcgctggttagagactttcctttctaactaccgtggtgccgttttaatcgtttcccacgaccgttattttcttgataaagttgtggataaggttatcgaaattgagcgcggaaccagtcaggtatttaacggcaattacagtgcctacgccgaaaagaaaaaggcacagcgtgatgcacagatgaagctttacatgaaccagcagcaggaaatccaccatcaggaagaagtaatcacaaaactccgctcctttaaccgtgagaaatccatcaaacgtgcggaaagccgtgagaaaatgctcagtaaacttgaactcgtagacaaacccgttgtcttaaacagcaagatgcgtatcactttagaaccagaagtcctcagcggtaatgatgtacttacaattgagggactttccaaatcttttggtgacaaagccttattccgcaatttaaatgtgcagattaaacgaggggaagttgtcggcctcctcggagcaaacggtacgggaaagaccaccctcttaaaaatcatcaaccgccagcttcgcgccgactctggtaaaatccgatatggctctaaagtttccatcggctactacgatcaggaacagcacgtactagacgatagcaaaacgatttttgatgagatttccgatgcgtatccaaagctcacaaacacccgcatccgtaacgtactcgccgccttcctttttactggcgaagacgtatttcaggtgatcggaaccttaagtggtggagaaaaaggacgagtttcccttgcaaagctgatgctttctaatgccaacttcattattcttgatgagccgaccaaccacttagatatccaatcccgcgagattttggaagaagctatcaacaattacgaaggaaccgtattctacgtttcccacgaccgttacttcatcaaccagactgccaccagaattctggatttatccccagaaggcatcgtaaactataaaggcaactataactattacttagaacaaaaagaggctggaaacatctcagcggacagcgataacatcacgctcacttccgccacagatgccgctctggctccttctcctgaaaaagcgaaagaagactggaagcgttcccgcgaggaagctgccagacagcgtaaacgtgctaacgacttaaagaaaacagaaaaggaaatcagccgtttagaagaagaaaacgaccagttaaaagaagaaatggcacttccggagaatgctactaatgtggcgaagcttatggagctgaatacgaagtttgaggaaaatgaggctgcactcctggaactctacgacaaatgggaagagctttctgaataaattctgggctgtaaatctgatataaaaaagcccggctacaaatgtagccgggaaataagccctattattcatttttaatacaaactaactattaataagctggtccaagatcaatccagtttttatcaacccatttaccctgtgttttattccaacggcgcttctgacgtcgtccattatgtacacgatagtaaataactatctgatcagcgcatggagtaatactatcttcttctacaatctccacaatttctgatccaaagtctacttcttccgcctgaatatctgctgacggaaataccattccaagactcataagaatcgcacctgccgctactactcttttccattttgcttttctcatcattacattatctctccttctatttataaactttataataggggttacttctataaacttgtattacttcaatagatttttattgaacttatcgtaatgtgtatttatattcataaccggagagaaatgtaaaaacgtatgtgcagtattgcctatcagtcttttcgaatctggcttcttctggaatccaccatatctgcaagttcttttaataagtcgtcatcttcctcatcctttaacagtgcgttaaataatctggataatgtacggctcgtatttctctgctcctgacggagctgattaattgaatattcttctcttgtcattgttggctggaaagttctggcataattcttcgttgtcttcttaaagccggcaacttctaccaaatccttatttaaaagggaattcagtaataaatgaaccgaacttgccttccatgttctatcatcagaaactcctacaatctctgaagatgtaagaggcttctcctcatcccataatacttctaatatctgtttctcactattggtaatctttggaatttttcttttcatgatataccccttttcttcattgtttaatattaagtatatcatataataaaatacaaaaaaattcaacaattagcctgtgaatttatcatccatatgtagttatattatctaacccttttattttttattatatttaataattggatattcctcgtatattccattttccacatcttcttttaatactttttcttcatatttaccatagtggaaaatataagtcccatctttctgttcttctaggtaagaattctctccatctgaaacaaatggtgtattctcttgatgcatatctgtcaatggtacaatatattctggctgtaagataaaataataagatgcaacaaaccaaataacactcacacccaagataaacaaattcatctttctctgtgtcctcttatcatccttcttaaacatcacataatgaaatctttgctttaatggtcttacttcaagcttctttacaaatcctaatgtatccgaagaaactttatcaaagttcgctcttctgccacctgccatataagtcagggtatccagataatacagggtatccatctcactgtatttcttcgacatcgcattatcacagtttaattctataatctggtctaaatctttgcaaagtaaatatgccaatggattccaccagaatatcattcctatgatattaattataaacttcttccacaaatcttttctcttccaatgaagatattcatgcatgagaataaattccaattctttctcgttacattccttctctggaagatatataactggatgtcgcagtcccttaataaatggttctgcaattgccagattatactcaatcttaatcggacattctgaatcaatttctcttaaaattttctctgctactccatctcctttggaagtcccttttataagatatccctttaccttattccattctctcatcttgtgaacaactgctatgataataccaattatccatattgtaagaataactgccataacaatcttcttatggatatcttctgacttagcatataaattcataagaaatgagtacaaatacggatcacatatcaccttctgatgactcggaaattctatcggaaatagcattcttaccgtacaaaatatgtaaagaatcgaaataaacgtaactccatactttgttaaataatctgatcgccttctcagaataaatatgaggagtaacatcggacaactaattaaaaacgtccatattaaagaatataatgataacataacttttccccctgcttattctgatattacttttcgtattttctacattatacactacacttgaataaaaataaatagttttttgtcgttttactacatttatttttttattttttgtttaatttttattttgtatcatattcagagacattttgtatttcaaacttaatcattatatatatagttcttagtatattagaatttttattaaaaattattatttttagtaagtcgctttgtgatatacaaaaaaatacctgtctgcattataaacttatgcaaacaggtatcgaattattcctctttttttcactttttgttttatttggcctttttaatgtggcttttgtcgtaagattttaaaaactgtgtcagacgatcacaggacttcgcccagacaacgagttcttccggacttaatgtttccatgatagcatctaacattttctcatgaaattcttcatgatgtttgtaggcagcaattcccttttcgaggagatagacattaactactcgtctgtctttctcacttctggctcttgccacataccccttattcaccagactgttcatggatgttgtgagagaacctacagtgatattcagccgctttgctactacgctcatgcgtgcaccatctccaagaccgatggcttctatgatatgcatatcattgttactgatatcggaaaattcatctgtgataattgccttctcttccagctctaaaatctcgtggaaagtctttactaacattgtgtttatcgtttctcttacatcgttcattcctatattctcaccttatctaataccgtatcgtttttatcgcatgataaccctataaatcatctggcctttataaagatctgcatttatgatggctgggatgtttcctaaattccatcgcaactctttatatttgtatacaattatggactttatcttcttttattatcattatatacaagaactacagaaataatcaattactttttttactgtttcgattgtttttgcctcataagcgcgtcctccgcagaataaaagggcattttctgtctctcctttggctgcatggatgagtgcttctgtgatacagtacggtgtttctgccggattacaggtatgaatacagcgaagacatttcgtcggcggtatccttccttcggattttactttatctaaaaatgtgtttctgattgctcttcccggcattccgaccggactttttacgataacgatatcttctttttctgcttgaatataggtttgtttatagtgttcatctgcatcacattcttcagttgtcacaaatcgggtcgcaatctgcaccccgtctgctccaagagaaaatgctctctcataatcggcatggtcataaatgcctcctgccaggatgacaggtatttttttctcgtatttttcttcgtatttttgtactacggtaataatcttctttacttcttctccataaatatctggagtaaattcttctaactgttctttatgaaatcctaaatgtcctcccgccatcggtccttctatcacaataaaatcggcggttcttttatattttttatcccagaattttaaaataacacgagcggatttctgtgtggatacaatcggggcaatcgcaatatcgctgtctgctgtatacgcaggcagatctacgggaagacctgctcctgatacgataaaatcagctcctgctgcaattacttcgtgggcataggtttcataatcgttcatggctaccataagattaaagccaacaattccatccggtgaaattgctctcgctttttgcatttctttatgaatggcacgtttattagcttctatgggattctcataaaaatctggttctttaaaaccaatctgtgcggcagagattgttccggctccaccttcttttgcaactgttccggcaagcctcccaagactgataccaacacccattccaccctgtacgattggaactcttacttgtttttttccaatagaaaataagtttttcttcataagttatattctcctataagtactaatattctattttctatgtttatatcaacataaaactcaaataactgactaattcagtgaaatactaatgtgacatcactgacatttcattttatttgatgtgaatcatattagttctttataaagcgttccctacatactgcgaaaacgctggtatcttgcctcaactctctctttttctgtcatttccttgctgttttctaaaaatgcggagatattttcttctaaattatcaaatacattcatcattgaatctaatgtataggattccggctctgaaataattttttcaacaaaacctgctttgtataaatcataagaagtcagtttcattgctttggctgcgcgggctgcctgactgccatctttccataaaatagccgcatagccttctggagaaagaatagaataaactgcattttcaagaatccagacttcatcggctactgccatggcaagcgcaccgccgctgccgccttctccgattaagacggaaagaattggggtctctaaggaagacatttcatagagatttctggcgattgcctcaccctgacctcgttcctcggcttccattccacagaaagctcccggtgtatcgacaaaacagatgattggacggtggaacttttcggcctgcttcataagacgaagtgctttacgatagccttctggctccggcatcccaaagttacgctcaatattttctgaagtactttttcctttcatctgcgcgataacggttaccggctgtccctgaaaataagcaatacctccgcagatggcggcatcatcgccaaagtttctgtctccgtggaattcgataaattcttcgaataatccgctgatataatcttcaccaactgggcggtctttttcacgggaagtcaggacgcgctcccaggctgttttttctgatgcacgtttcttttgtgttgcggaaagtttttgtttgcgagagtttttcactattttaactgtctgacctacttcctgttctgatgccactgtaatatcaccatcattgaagactgcattattgcctgtattctccgctaccccttctgctgttaaacggtgcattgtaagaatcttctccaacaccgttttcatatcttttctctcaacgattttatcaataaaaccgtgttttaagagaaattcggaacgctggaatcctttcggcagcttcttgtgaatggtctgctcgataactcgcgggcctgcaaatccgatgagtgcctttggctctgctaaaatgatatcgccaagcatagcaaaacttgcggtaacgccgcctgttgtcggatctgtgagaactgtaatgtaaagtaagccagcgtcactgtgtcgttttaatgcggcagaagtcttagccatctgcataagagaggtcataccttcctgcattctcgcaccaccagagcaggtgaaaataatgacaggaagtttttcttttgtcgcgcgttctacacctcttgcaattttttcaccaacgacttcacccatacttgccataaggaatcgtccatccatgaccataagagcaacttcatttgctccgatgcgagcttttcctgtgatgactgcctcatctaactttgttttttcctgcagggatttgattctgtctggatacccaatcatatggagaggattctctgttgtaagcccggtatcccattcttcaaaagaatccttttctgttaaaaatgcaatccttttctgggctggcatacgaaggtagcctccgcactttggacaaatatataaattcttcttataatcttctgtgaaaataccctttccacatttattacagcgttttaaaagtccttctggaacttctggctttaccttgctggcagcttcttttacttccggctttgtgacgggtgttttcttaaatatactttttaatttcataaataaatcctttcgtacataacaggtaaacctgttatttttttattacgggccgctgactatttatttttcccatctcttcaagaacatgtctggaaaatgtttctgcaagatgtacatctaatttacaaaagctttcgcttaaatgaaagctacatggcgaactacgtcggccgaatagataggaaatacatctcaaaaatacaaaataagatgtgaatcttactttttgatttcctgactacgttcttcaagcaccttttccaaatactgaatcgtaaaatcgccctcctgataatccggacgttccataatctcataaaggaaatcaatattcgttgtgattccctcgatgataacttcgcctaatgcacgatgcatttttgcaattgcttcttttctcgttgccgcaaatacaatgagctttgtaatcatagaatcatagtatggggatacttcacatccactgtagattgcactgtcaatacgaacaccttttccacctggaagatacatatcggtaattcttccaggacatggacggaagttctttgatgggtcttccgcattgatacggcactcaatggcatgaccggtaatctggatatcttcctgcttccatttcagtttctcgccatcagcaattcgaatctgtgctttaatcaagtcgattcctgtaacccattctgtgacaggatgttctacctggatacgagtgttcatttccataaagtaaaagcttttatctttttcaaggagaaattcaatcgttcctgcattcttatatcctgctgcctttgctgcaagaacagctgcctgtcccattttctcacgaagttcctcatctactacggcagatggggattcctcaatgactttctgatgatttctctgcacagaacagtcgcgttctcccaaatgaatgacattaccataattgtcggcaagaatctgaaactctatatggcggggattctctacaaaatgctctaagtacatgctctcatcaccgaaagcaagtccggattctttctgcgccattaagaatgcattttcgaactcatcctcattgtaagcgacacgcattcccttaccgccgccaccaagaacggcctttacgataactggaaagccgattccttttgcaatttccaacgcttcttttacatcagtaagcgccttctgacatcctggaattactgggacaccagcatctaccattgtctgtcttgctactgccttattgccaagtcgggcaataatatcagagtccggaccgataaaagtaatgtggcaggcctcacacagtttcgcaaactggctgttttctgataaaaaaccaaatcccggatgtatggcatccgcaccggtaatcatcgttgcgctaataatctgctccatattcagataactgtcttttgctgcagcaggtccgatacagaccgcctcatcggcaagctgtgtatgaagtgcctcccggtctgcttcggaatacactgcaacagtttcaattcccatctctctgcaagcacggatgatgcggatggcaatctctcctctgtttgcaatcaatattttccgaatcattatgttctccttttatctttattgcgacaacttctgccacaattctctatcctaaaattatactatttctatgttctatctatcttccttgagacttattctgatgaaaaatcaaccaaccataaaagttaattctgcctttactactacttttccgtccacataggctgtggcttctcccacacccatcgggcctttacgttttacgattttggtctcaagctttactttatcgcccggaacaattttccctttaaaacggcatttattaattccaccaaaatatgctgtctttcctttattttcttctaaggaaagtatggcaactgcccctacctgcgctaacgcttctacagtaagaacacctggcataactggctcctgtggaaaatgtccacggaaaaagtcttcatgaaatgttacgcatttatatcctacggcactgacacctggttccatctcttcgatgtaatcaactaaaagaaatggatgtctgtgtggtaaaatctgttcaatttctttaattcctaatctcataattttcttccaacctgtttactgctttacttatatttataaaaacctgtttttactttctgttaaagcttctgacttattaacttgagaaaatcagacttaaattcataccttatcaatattactgaattctgaataacggctgtccatactccacattctcttcattttctacaagaatttccgtaacaacaccatcgaattcgctctcaatctcattcataagcttcattgcctcaacaatggccaaagtctgccctttctttacggtatcccctacttttatgaaaggctctgcatcttcagaaggtgctgcataaaatgtaccaactaacggggattttacgaggtttccacccttttccccgactgcttctgctgcctgtgactgtgcagctgcagtagctgcaactccctctgttccggctgtatttgcaccattcacgctgtttgcgctgacaccaatggcttcctgtaacgcaatgtttgaagctggcacaacgattttttcttctggctgtggacaactcatggcaatgcggatattaccctctgtatattcaaaattcgtaagccctgcttttgatacttcttttactaattctaaaatctgctgataatccatatctgtctactcctcgtatttctttacaagaagagaagcgttatgtcctccaaaaccaagagagttggagatggctacattcacttcctgctctactgctccgttaattacatagtcaagatcgcatccctcaccaggattggttgttcctacggttggatggatatagccttcttcgatggacttcacacaaacgattaactctaccgctccggctgctccaagcaaatgtccgatcattgactttgtagaactcatttttaaatggtctgcgctctcaccaaaggcacgtcttacagctcttgtctcaaataaatcgttgtggtgggttcctgttccatgtgcgttaatgtaatctacttcttccggttttacacctgcttcttccatggcaagttccattgcttttgctgcaccgcttccgtcctctgcaggagaagtgatgtggaaggcatcacaggtagaaccatatccggctaactctgcaagaatctttgctccacgctttttcgcatgttctaattcctctaatacaacaactcctgctccctcgccaataacgaatccgcctcttgcctcatcaaatggaagagacgcgcgtaacgggtcgctctcactggaaagtgcagtcagatttgtaaatccagcaacggcaactggtgtgatactgctttctgttccaccggcaagcataacatcggcatctccgtactgaatggcacgaagggcatctccgatagagttacttcctgtcgcacatgcagttactacgtcagtacatttgcctttgcagcctaagtcaatcgctacatttcctgctgccatgttggaaatcattaaaggaataagcattggactcactctctttggtccctttgtaatgattttctcatgctctttctccatgctggaaagaccgccgataccggaaccaatgataacaccgacacggtatggatcttctttttccatatcaagacctgccatggcaaatgcttctcttgatgcagctacggcatactgggagaaaacttccattcttcttgctgccttgttatcaagtctttcttttacattgaaatcttttacttcggctgcaatctttactttataatcttcggtatcgaactttgtgatagctccgatacctaccttttcttctttaattccattccagaattcgtctaatgtgtttccgattggagtcacagcacccattccggtaattactactcttcttttcatatcagaaaaatcctttctctcacttacatcaccataccaccatccactaaaagtacctgaccggtaatataagacgctttgtcagaagctaaaaatactgctgcattcgcaatatcttccggctctgcaaaacggccaagtggaatctgtttctttgcattttcttttacttcatcagaaagtacatctgtcatctctgtttttacgaatcccggagcaatagcgttacaggtaattcctctggacgctaattcttttgctgcggatttggttaatccaattattcctgctttggatgcactatagttcgcctgaccggcatttccggcgacgccggaaacggaacttacattaatgattcttccatatctctgcttcatcatgcgacggctcgcaaaacgaatcatctggaaacatccctttaagttcgtatctattacattatcgaaatctgcttcactcatagccattaaaagaccatcttttgtaattcctgcattatttacaagaatatcaatgctgccaaatgtcttggctaccgcttttactaaagcattacattcttcaaaatctgcaacattggcacggaaaatttctgcttttccacctgcctcttcaatttctttttttacaagaagtgccttttcttcatttccgtgaaaatgtacggctactgctgcgccttcttttgcaagagcgatggcaactgcttttccgattccgccggacgcgccggtcacaattgctgtttttccttctaataacatatctataactcctttatagcttccactgtcttgtcgatatcttccatcgttccgattcggaacatctttacgttacggtcaatctttctcataaaaccgctcaaagtctttcccggaccgatttctacgaaaacgtccacaccgtctgctatcatggcacgcacactctgctcccataaaacggaggaataaacctgttcttttaataattcttttgttcttgtcgtatctgtcacgatacttgcatccacatttgtcatataaggaatctttaactctcctaatgtcacttcggaaagtgcctgataaagcttctcccctgcttcttttaagtaaatggaatgaaatggtccgcttacatttaatggaatgacacgttttgctcccgcctcttttaaagctggtgctgcattctctaccgcttccttatctccggtaataacaatctgtcccggacagttatagtttgcaacgtaaacaccttccatgtatgcaatcgcctcatttaccgcttctccagaaagaccaagtacagcggccataccgcccttaccttccggtactgcgttatgcatgaggtttccgcggagccacaccatcttaatagcatcctcaagctccatgccgcctgctgttgtaatcgcacaatattctccaagactaagcccggctgtcatgtctggtgtaagccctcttgccataatctcttttgtcattgccatacaggtagtaactaatgcagcctgtgtataatccgttctgtcaaggagttcattttcctcaaaacagatatgtttcatatcctgtcctaaaatctcacagctcttatcaaatacttcttttgccagtgggcttttttcataaaaatctttacccattcctgcgacctgtgctccctgtcccggataaagaaatgctattttactcatttactctacctcccgatattctctgcctgtgaaagaacaacgttcttcatctctctgcagattccttcgataatttccttacaacttctgctgtcctttacaagaccggcaatctggcctgccatcacacttccatgaatgacatcaccgtcaacaaccgcctttctaagaccgccaagtgtcagcttctcaagttcttcaaaggaagcgcctgcctgctctaacttcaaatactctcttgtctgctgatttcttaaacatctaactggatgtcctgttgttcttccggttacctttgtatcaatatcttttgctttaattactttattcttataggcttcacttacgatggattccttagatgcaacgaaaatcgttcccatctggatagcctttgcgccaagcataaatgcggctgccattcctcttccgtctgcgattccgccggctgcaattacagggatatttactgcatcaacaacctgtggtactaatgccattgttgttgtctctccaatatgtccgcctgactcggtaccttctgcgataaccgcgtccgcaccagccttttccattcgctttgcaagagcagtacttgctacaactggaatgacgcgcacaccggctttcttccattcttccatgtacttttccgggttacctgcaccggttgttactacctttacttcctcttttacaagaagttcggcgatcgcatctgcctctggatttaataacatcagattcacgccaaatggcttatctgttttttcctttactttatgaatctgttcttccacccaagaagcaggtgcaccgcccgcaccaatgattccaagtccaccggcttcggaaacagcggcggcaagctcggctgttccaacccatgccataccgccctgaattaccgggtactcaattccaagcaattctgtaatcactgttttcattctttgtccctctgcctatttatgttctttgatgtactctacaacgtctccaacagtttccatcttctctaactcttctgtagggatttctacatcaaactcatcctcaagactcataaccatctcgaaaaggtcaagagaatctacttttaaatcctctttgaaagatgcttccattgttacctggtcttcttcaattcctaaagattccacgattaattctttaattttttcaaacataatataaacctcattctttcttatactcttacattgttttcttctttatgtaatccggaaattccgggaattacctttttaccattctaaatacatgccgccccatgtaaggcctgcgccaaacccggcaacaactatcttcattcccggctgtaactttccggctttctttaattcatcaagcagcaccggaatactcgcagaagacatatttccattctgcatcatatccatcggaaacttttcaattggctgctttaaccgcttagcgattgcctcgacaattcttcggtttgcctgatgaagaacaaataaatcaacttcttctacagactttcctgccttttcaagaatttccttcactacaacaggaacctgtctggctgcaaacttgtaaatctctctgccatccatcgccacataaccctttaaagaaccatcggctctctttcccgtcggattctgacaggtaagtacttcacctctgcttccatcggaatgaagtacggaaggaatctcaatgtttcctcttccatctatattcccatcttcatctgcactgacaaccgcagctccggcaccatcaccaaataaaatacaggtacctctgtcttcccagttcacgatattcgacagacattctacaccgatcaacagcgcttttttcgaaagcccggccttaatctgtccggctgccatctgataagctactataaatcctgaacatgccgcatttaaatcaaatgctgctgcattcacagcaccaatttccttttgaacactgcaggctgtacatggcaaaagctgttcagacgaaacacttgacacaatgagaaggtcaatctcctctgccgcaacctgtgcatcttccaatgccctcttcgccgctttcgctgccatagaaactgctgtctcttccctggcaatatgccggctcttgattccggtacgactctgaatccattcatcgttcgtatctaccaactgagaaatttcaaaattatcaagcactttctcaggaaggcaggagcctgtcccttttattttgacaaacatcactttctccttttcttgctcatatgattacttctgatcacttcgttctgatattctatgtgaatatttttattttcaaatcttattgttttgaaataatattattttgaattaaaatagtttgaatatcaaagcaagtgattacaaatatatcatagctggtggagaagtcaagtattttttttgatacaaatggacaaataggaatttgccggggtgagtaaacagacgaagtctgagaatcaaatcatctatatttgtgattttcgtcgctacgagaagtcgtcttctaagaaaaggccggcatgaaaaggtattgattttgactcagttgtacaaaacacaaagtcgtcaaaatcaataccttttcatgctggccttttctaatattttattatagtctcgtagctcccagaccacaaatatagatgatttgattctcggacttctgtttcctggctgcccgggcaaattagcggaaagatttggggaagaagtcaggagagatagaaataatccgggaagttaaatatttcaggattgacacacgattaataagaaaaaagagtatattatcggtgtactattaccgataatccgttctcagcaaaaatatcatatattcatctgttttgatgtgttttcagcgtactacaacaataattcgagtcaatccttcaaaaaacaactccacagaaagccaaaaccttctggagattctccaaatccctccagcaataaatagaatttccctccccagccaaagcacagcccccgaagagagtctagcccctatatttgtggcctcggagcaaggtttggatacgagcgtgtataagcgagtattcaaaccgccgcgactaaagtcacaaatataggggctagactctcttcgggggcgtctctttgcctgcggcaaattcctattttcttatttccttgtctgtgctatactctgttaaaatagaaaggagaataaatttctatgaaaaagaaacaaaaacatcatttcacggggaagaaatggattgcagcgctcgtcgttgttgttctgattcttgcagcaatttactattatatcgctcttcccgcaataaacatccataatccagagttgtggaagtttgtattatttttagcagtgattatttttgcactatatgcccttccaaagacaacatttaccggtgaccggagacatcctgtcaatttcagtggcaattataagacaaagacattcaagtttttggcttctcttgttgttgtcattgccgccgcttattttgtcggcacgcttttatcttctcctgttattaatgcttccaaatatcagaagctgatgaagatagaaaaaagtgaatttacaaaggatattgaccagatttcttacgaccagattcctctgcttgataagtcttccgcagaaattcttggagaacgtaagatgggaagtcttgtagaccttgcttctcagtttgaagttgcagatgaatacagtcagattaattataaaaataatccggttcgtgtgactcctctccgctatgcggatctggtaaaatggtttactaataaaaaagcgggtattcctgcctatatcaaaattgatatggcaacacagcagacagaacttgtccgcttaaaagaaggaatgaagtatactccttatgaccattttggacgttatctttaccgccaccttcgtttcaaatatccgacctatatgtttgatgacattaatttcgaaattaacgaagaaggtaccccttactgggtatgcagcgtaaagaaatataacatcggtcttttcggcggtcagaccatcggacgcgttgtcttatgtaatgccatcaccggcgaatgtaaagactacaaagtcgaagacactccaaaatgggttgaccgtgtatactctgccgatatgcttgtaaatctctacaactactacggcacattaaaacatggatttatcaacagtattctcggtcagaaagactgtctgaccacaacaaatggttacaattaccttgccatcaacgatgatgtgtgggtatacactggtgtcacttctatcacaagtgatcagtctaacgtaggcttcgttcttatgaaccagcgtactatggaaacaaaatattacgaaattgagggagccatcgaagattccgccatgacttccgcagaaggaaaagtacagaacttaggctataaggcaacattcccacttctcctgaatattgatgcggaaccaacttatttcatggcattaaaagatgcctccggcctcgtcaaaaagtacgcaatggtaaatgtacacaattaccaaatcgtagcaaccggtgacacagtaaatgactgcgaagcttcctatcgttccctcatccagtcaaatggcatgggttctgatgaagaaagtaaaaaagcttccactaaaacaacagccggcactatcaaaaagattgctcaggcagttattgacggaagctcccattattatattgtgttaaatgattctgatacgatttatgatgtggatatatccaaatatttggatgcaatattgctggaagaaggagataaagtaaccatagaatacaccgaaggcaatccttccacagtaaataaaatatctaaatcctgattcaaatgagacgctctcagtaaataaaaataacctatatttgtgactttagtcgctgcagtttgaatactcgcttacacacgctcgtatccaaaccttgctccgaggccacaaatataggttatttccttttctgacttcgtctgtcagttctcccgaccctgcaaatcaaaatccaagtttgttaaagtaaacagtaaagagaatctaatttttagatgtctgataatatacgaatatcgttgctattttatccatacattatttttcatctattattttttcacaaacttacattttccgagtccatacgtagataagagtttcttataaactttatatttgctctttggaacgtacactttcgcatggttcacacaaataaatacatgtgggtctttcaaagtctttaattttttccctttgaaaactatctttgtaatctttttgttattacaaaatgcatgggcaccaaagaaggaaacattctttccaactgtaagctttttcatgttcgcacatcgataaaatgctttgtggcaaatcttttctacagaatctggtatgatgactgttttaatctttttgtttgcttcaaatgctctcgttccaacagaagttacattatacttaattccgttccatgctatactctttggaaatgtgacgttctttgctctgcgtcctttgataaaaccagccacttccatctgaccagttccgtctacgctggaatctgtcactttatagcgatagattccacttgaaatcacgtcaccctgacgaagtcctactaatacattacaagatgctttctttccactctctgttgtaacagtaattactgcttttcccggagctgctgcgctaacatttccattcttatcgacggaggcaatccttcgggctgtactactccagcttaacttatctgtgctattagatggagatacgatagcttttagaacttctctgttctttggagcaattaccagattatttttattgagtttcacgccagttgctggaattttattacttacagtaatctttcctgtcggttcatccatataagtatctttgattgcatattttactgtatatactacatctgactttccaccaatgttcgatggaatatcaagtgtggcactctgactgtctgcatttccactggtaccagcttccgtaatcaatctgccatctgcatcaaacaatccagccttcatgttatcttccagacattttccttctaaagtgattgtgtttgctcctgcagtagcaatcatcttttctgtgttctttaagacctctactttcgggcctacccagatttttacgctggaaatgatagtattaccattctcatcctgcatctcattggttgtactgctatttacagccattgcagaaattgtaatatagccatattcatcatatgtctgaagaatattcttcgctgtatcaagcttgcaatttattccattggcatctaatgagaaaataactttagcaggatatgcttttaaatcttcctcactatatatttcacctaactcatcatagcaagttgctttcagtgccgttaaatccaaagtactgttaaatggaatggcctccggtacttcttctaacgtaatcttctggagcgaacgtactctaggaacgcttaattctacttcattacttaccacattctgattcagcttattcgttgcgctgactgcaatattcgctttcttgcctgcttctactgctgcgataactttattgttctcaaaacggaacgctttttcattatccgaattccatgtaatgtctacttcatccagtccatattcctctccatactggtcaagaccttttacagtgaagtattcatcgacataagcattctctccgtttttcaatgtactttctgcatctttcttctctaactgaagggtatccagtacaggcttttgtcttacagttaaagtaaactgtactgcctgtgcttctattccattcttattagtaaacgttcccgtcaaaataacattgccagtttctccatagccaagtgttccctccgctacagataacgtctttttagctgcactaaaagatgcctgtgtactcttaatcgttcctttatctgtcaatttccactgaattctgtcaatttctttctgcgaaagaatatatgcctctccattctgatcttttgctgtaaagtttactttcgtaagatcatactcttctccttctcttactactgccgaatcaccggtatataattccttcacatatggtttggtaacaatggcaaagtctattacattcgattctatctttgcatcatctttgcctacgattaactgaagcgtatcagaaccttttacaagaccaagtaaagtatctcctgtaactttagaatactttccgcctgtcagccatttgtattcctcttttgtccagtcatactcgtctccatactgatcaagtgcagttacttttacatcttcttttaaatcgctggaataagaatctccaataccgattccgtctttttcaatatctgtctcaatattaagtgaagtcagcttccttgtcggttttactaccagttctaatacattagattctgcatataccgctctgccttttcttgctcttgcctgaatcttataggttcctgccttatctattggaagtttattcgctaccagataatcagagaaactgtcttctgctttttctcctgaaaaatcaatatgccattttacatcagaaagatcattccattcgccatcatactggtcaaatgcttttactgtaagtttggataaatcaataatgtcaggagttcctttgtctttgaaaataaagctttctaatgtagctggttttgtatcatcagagatcttaagcgttgtcagcgctttttctggaagtgcttttacactaatccattctgaatgtttgcctcggtaggttgcccgaatctgataggttccttcctttgtaaaagatacccggttattctcaagcttgattccatcttcttcgtcaagtcttgcttcccatacgataggtgcaccggaaatcttcttatctgtactgtctactgcatatcccttaatgtcttcgttaccaatcagattgacaggttcctcaccaacatatattgtcgtagttccctctgcctgaacacttccgtcaaatggttttgctgtaacatttaccttaatttttgctgttgcgtcaaggcctgcattcgtagctggttgttcattctcaagactggtatatgtagtatcatcattaatcatatacttaagatacagggttccttcttcgtctcctgctgtcagaatcgcttcaccgtttgctttttcctctgtaagagatgcaatattactgcctgtcagttccttaccattctgatcaataagtatccaatggcccttattctggtcaaatccataatactctacatcattcttgttactgcctttcaaggtaactgtactaagatcaaacgtatctccactaatcatattcaatgtcttcacgccatttgtgacactgattttctttaatggatataatggtacaatttccttaatatttgaattcatacttactgtatcataattaagtacaccacctgtgacggacatcggacaatgtgttgacagccaggaaaccttatttataagactgttgtttgttccagctgctgctctttgtgcagtattggcagactgttttacggccttatttgctttctgattactattggcacgctgtcctgttgttccactttctggtgcattttccgtatagtagaaattcacgctgttcagcgcatcaagttcttcctgagatacgccctgttccgctaatgacttcttttcttcctcaccaattggctgaatccatttgttataagtatctccattcgcattataatttatgtcattatctacttcttcaccattactatccttcacagttttgtcatatatcgtatacttctttgtattttgtgtcatcgttgaaggaacttctattaatgattcatagccaatcggatattctgttccagaaggttcggatgaaaaagtatgctgaattacaccgtcctcatctacaagaattctatttagtgtaactttcgtcttttcatctgtaagttcttcttccttaatcgttccgtttaaaatatctttccattccagtttctctaatttatctgccggatttccatcagaccgtttctttgtccatccataagtctgtccatatgcctgctcgtaatttggtgtcgcggtatatcttactgcacggttataaagattatccattgctgtcgttccgcctttttcagactcagaaccaaaaattgtgctgaaatggctctgacgatagcctgccgtagagaatgattgtattttcatattatcatcatatacagtacctgataaagagaaaaccgctactttataagtaatcgccaccggacagtcatatccaagctgcacatttgttactgccttagaagattccattccaaccgctgtctgtgccggaagtgacatgctggaagaaatcgtattctcggaagtctcactatattcttttgtttcagaatatgctgtggataatgcctgctcacaggtcacctccatttttaaagtctgctccacctctgcaatcagcggaatctctccggaaagtgttgtttctgagccaatcatctcactgtaagaataactttttcctgtctctaacgtattagaagtcgtcagggaattcgactgtttaaattccattccaatatctgcttcctctttcgactcattcttataataactcaatttaggattcgagttggcatttgtcttataagtgacacccgcagcctgtccatttactgcttcttttaaagaatcatacttctgtgcctttgtaatatactctaacccttctccggcaattaccgataatttgaaatcataaaaagccagtccaaaagtgttataacaaaatcttggtgtggatcctacacggtccacgcaagttacaagcgaatataaaacatcctgcgttgtgtcatcatcaatctgctttaacgcagcatcctggccttctgtactgttaagaatgctgcttccactaacctttcgattaattccggaagcaatctcttctgctgcctgctgacgaacactctttaaattcttagcataagcaagtcctgtccaataggtattatcttttccactctttctatcactcttaggttctttttgtgatagtgcataagcaacatcagcataaccatttcttgtacggttttcttccccagtaaagttcttagcaaaacctccacctgcattcacaaaagcggcatatttgttatgggttccataaatctgctctgccagagatgcccactgtccaatcagactgtctgttccaccatctgtttcattcccactttggagtacggcctgtaaaaatgcaatctgattgtttggatctacgcgatctgtcacactgccatcatgaatatcaaaatacttcttatcattaataatgacagagcgaatccctacacgattctttgtttcagttccatcaccatcatatcgataaagaacagatacattggaagccgcctgtgttatcagcggagcggataacccgaatactgctgttaaagtaagtattgcggcgaggactctcgctaatacatatcttgttttctggtacttcatacatttcacctcttattctgcgtatctcatactttcttcttttggtctgatttcttattctgaaaccagatacataccatcgtaaaaatcacacctgctacaaaagcagcaacggcgataatcacatataaatccgccccatctcttaggagaacagagccgtaactgtcaacaacagcaggtacaccagataaatgcatctcttgaaacattatccccatacatactgccaatccgacggaaaggagtgtcaaactaaaaatgatacatctgtcatatcgaatacgcagaatatgaatacgctgatgaatcttttccctcctaatctcctttgggttcatctttctcctcctctctactcatttttacattgtacttctataaagacataataaaaaaaatcctttcacctatttaaaaaaataaatgaaaagattttaaaaagatcttcatgcatgctttgcttatcaaatcaaataccctgtaattggatcgcagggtatacccgcttccttttcttttgtaagatcccaattttcctgactttacttcatatgatttaactttaccatcaaatgccatacactcaccagcacaataatcatgcccgatggaaacaaataccccatccacctccaaatgccatctgccgaaataagcagattaaaaattgcatgaaaaacaccacatgcgccaagaagtccaaccattcccgtaattgcaattgccctttgtctaaatatataggcaagtccaaagccgataaaaataccacataatatatgaagcgctcccgtcgaaattccccgtattaataaaagatcaaaatctgcagccccattctctgttaaataacacacattttcaaaagtagcaaatcctaccgaaattgcaatagcaactcttggaatctggtctctctgcggctcaaatattaaaatataaaataataacggaaaaagcttcattacttcttcacagaccggtgtaatttcaatggaggcctctattgtatccactccataataattcataaaaaaactgctgacatatgcagaaagcacacatattcccattccaatacaaacaaataatgtatatttacgtgcttctccctgaataaaaatcaatgaaagcaataatggaatactaatacaaatgaaaatattttcaatgtacatcatctttccccacctccataaatgtacaaggtaataacatcgccatcgaaattgtcagcacaatatcaatgcaaaaatacaaattaaaccttgtatagtcatgaaaaaaagacgaacttatatatagactcacctgtaaaattatacataatagaatacaaatgctgcttttatatggtgcatcgccatataaaatctgaaaaacactaatgtagacaatcgctcctgctgctaatgtaaatactcccgttgaaaggatcgccggaccaaaaatcccactccagattgaaataatcgccacaccaattccacaaatcaacggaatcactgatatcttcatcctctgtcccttatatcctacaatctgatacgaatgcagaaacaaataactggcaatccaggaaatctctgatacataaaaaaactgtggtacctttccccggataacaagatatagtacaaagtaaagtgttcccatcataaaacagctatgcgccaaagccaatataatatacaaacgattcttgtgcaaaaaccagcacacaatatctgccaccacaattagagaaaatactattacctgaaatatattatcaattatctcaaaattcattctatttttccccgctttgttattgttattcttttttcagactgttttcgcgcacctgctgcgattgtttatattcttctgctttttttcgatgttcttccgccttacgcaaacgatacaaaagtatcgttacagaaacaccaagtgcaaatgccaaaattcccatacaaatgtatccaagtgcctcataatttcccaacatactagccattcctgttgtataattagtttttgccccagaagcggaagcctgtttggttacttctggcatcagacatcctattccaataatcatcaccaggcatgtagcaatccctgatccactgattactctctctctttttttctgctgttctctttgaatctccagcgttcttctatgaatcaattgctgacgttcttcattcgtccgcatatataaaacctctttcctctaaaatcttttttaaactcttcttccctctatgtaccagatttgtaacctgtttttcactcttaccaagaatccgagctgcttctctataactcattccttccagactaaccagatacagtacttctctatactctcttcagattcgccattccttcataaagatgctgctcccgctccgactgcaaaagttttgcatccaccagttcttcgcttggtagctcaaaatctacctcatctaaatgtaaaaaccatattttatgcttctgtctatgccgtatcgtcaaatttcttgctgttttatacagatatgccctaaaacttccttttccatcaatcggacgctcctttgcaaaaatctgtgcaaaggcctctatcatcaaatcttctgactcatgaatatcatggatatatccatttatgtaatatgtaagtgcatccccatatctctcaacaagaatatctgcactctcttctttcccgtccaaatactgccgataagccatctcatccgaaatcatgccactccccctcttccgtatattcttgttctttattgtatatgagtatttgatattttgcaaaatttttttgaatttagggggaagataaaaaataaataaattactctgtcatgtctattacactgttcgtatatgaaatcaatcccattttatcaatatatatttttgaacttaatgcatcctgaaatgcactattatctggatcaacaaatcgtcccatactttgttcctcctctcatatattttcatccattttttattatatcaaacgaactttctactgtgtctctattttaatctaaaaaaatactaaattcctacatggtatttttcatttacattccattatgtctctattttaatgatttttctgtagaaatattttttatctaacctcttatttacattccattatgtctctattttaattaataaaacattaaaagtagtaaaaacacgtcattaatttacattccattatgtctctattttaattatcataatcctcgaatggattgtttacgccgtctccatttacattccattatgtctctattttaatttagatgtgtactgccatgcaatattagctgtggtatttacattccattatgtctctattttaataaagaccgcaacggcaaaagatgcgaatgtggctttaatttacattccattatgtctctattttaatgctcttactgcacttctggccgctgccgttacaaaatttacattccattatgtctctattttaattctattttttcccatgttcctccaaataaaatcgtatttacattccattatgtctctattttaatagaagtagcatctgatttagaaaaaccagatgcaaaatttacattccattatgtctctattttaataaaacagtagactactttttttcttagctttatctatttacattccattatgtctctattttaatgatgacgtgcgtggttctctggctgccatacaagctaatttacattccattatgtctctattttaatctaaagacagctcattgagcttcttacgcacttctatatttacattccattatgtctctattttaatcagtatgcaaatggacagctcctttgcctttctgatttacattccattatgtctctattttaattttatctggttcttgcaatgtccgcaataatttttatttacattccattatgtctctattttaatgtccagaagtgttaataatttctgccaatttcgtttatttacattccattatgtctctattttaatgtatgtatcatcttcgtagaaatatccttttacttcatttacattccattatgtctctattttaatcggaggtaagaaaaatgagcaatcccaaacacgacatttacattccattatgtctctattttaattaatacttaatcctaaaacttttctaatctgattatttacattccattatgtctctattttaatgataatccttaacagatcggaaccagcggtcaagctatttacattccattatgtctctattttaattacgttgcggatcttataaagtttaagcttgagtattatttacattccattatgtctctattttaatcacagaggtgcaaggactatctgtcccatgctcttgaatttacattccattatgtctctattttaattcattcccgatgcttacttcgtatattgcatatttatatttacattccattatgtctctattttaataatcaacagcgttaatggatactgccgccggaatcatttacattccattatgtctctattttaatccatcctccccatctctttttattttctttcttttccacccactttctgtcgacctatcaatagctataaatattttaccatatttttcttgtttcttctacaagattgatggaaaatgtcctatttatcgtgttttttaatcgctgtcaatgtacggggatttttacattattggaggtcgacattttttatgtaacatatctcgcaacaaagtgacacaaacaaaaatattataataacacgatatccacattttatgctttgctattcattatcttccgttttctttgtccattctatcgggctatatccttttttgtcatagttacattccataactttgattttctcatattttcctatttgaattggttcataatattttgcttttctgccagaagtttttttggaatttagagcatcctgataacttttccaatgataatatggaacgttaacggtatacttcataatctggtttcttaatttttgtcgctgtataacagaaagatccgcttgttttagcttttgaacgcactccaagatttgagtagatttttcttcatagactggacttggaatgattgtttctgttacaatttcacgtaatttcttttcatttttttgataagaatacggtctaatttcactaacatatttatatgtttttttgaagctgttcataaagtagctgttctgtatattttctgtagtgaaatatttctaaagcatctcctgtttttgactttctgtcaatattccctcatgttcagatattgcttttttagaaagttcatatagcgtagcatctataaaaccatataccttttccttgcctcttctcccagttcttttcgtctttccaatcaaatctgcagaatcaatctgcaggtaaatataacagttagattcgaaaacactctttaagcctttgcgattacaccgtcccattctctgtaatagggagcataaatcctgtaattctgttaccagataatcaaaatcaatatccagacttgcttctacaaccgaggttgttatccagattccgcccttctcgacaacattctccgacttattaccagtttgtccaaactctataatttctttttcaagtttttctctatcttcttttataaagcgactatggaaaatatgaatttcttccttatcatattttgcttttatgagttcgttcacatcatcaaatatcttctgtgcagtttttattttattgcacacaacgagtatcttattgcctttatgtggattgcttttacatgcttctttatttttcagatacagctttacaatatcttctgcatttatttttttatcacaaaccttgatatgatgtctcgcttttttatcatcaataaagacttcctgattttcttttgggatattgagatgctgttctagcaattcttttacaaacggaggcagggttgctgttaatatggcaacttttccacccatcttcacgattttttccaatccaaaaatgagatatgccagtaattctgcattgtacatctgaatttcatcgatcacaatccttgaataagataacgtggccagttttaattcatatcccggatactggaaaatgaaatcaaaaagctgatctaatgttgaaatattcagcggcagtgaaaattgtttccctcttttcacatattcataaatatcttcatctgaaccttctatattctttgtatagtattctaattgttcactatgtaaaattcctacttgctcatcaattttatctgaatttacaagcatatctttcctaagcctgttatatatcgcgttaattgctgtgcgaattggcaaaacaaaaaatcctttgtgattccctatccaaagaaggccagcttctgtctttcccattccagtctgggcaaccacaatgatattttgattttgtttttccttgcaaaaatactgtagagaattccaatcaacagtcgccctttcattttcatttttatcctgttcagacaatgcaaactcctctgccgattgtatctcctgtttttcctgatctgcaggattattccattgcattaaaagatattctaagccagataacaaaaaatcatttctaaactctatcggataatgaccacttgcagcgtaatcacatttatgaagcagacctttcattttcacagctttctcatcttttaaccctataacttcactaatctcctcttcgatccctataggaaggctatatatctcatcctgaatatccggaaaagcatcctgtggaaaaatattttctaattgcctcttgctacttgataccattctcatcaaatcagaattataatgatgatataatattgcaaataacatcctgacataattctttttatcttcaggatttattttgttgactctttctgaatcaacaaaaaatagagataatacattatgcggaatttctttttccaaatcaaaatgaagctttttattcttcattcttgcctgaaatatttcattaattttccctaaatcatgatactcacaggctatttttaataattcatacatttccttttcaatgtatcctaattcatatagtttgtccaacgcttctcttagagctgcattatgtatcactaatgttgtaactttatccgacttagcccaatacttacttgtatccatttttttccatcttaaaataatattaaataaaattcactatatattcatcttcatcaatatatacattttctccaactttattaatttcatagtttgaagtatacacaactttctttttttgaaaaattcgctttccattctcaggcgatatctcataatttttatttaaataatagaccgttcctctgacatatttatcctttctccccaaaggataaattcgcactccttccgaattacctctttttatcgtatcataatcaatatacgccgagtaaatattattcacctctttatttagtttctcctgcaactctactatcttcgcctcctgcacatccaccatatcctcgctacgtccaatcgacttgatatccgtccagtgttcctctaaatcatgcaacacttcatcagaagcctgtacgtgaataaccaattcaatattatttaaaatctcataatattttaccgacttcaccaaattacggaaatgagaaagtggctctgtataattttcatatttatatttttcgaaccattcttttatctgcttttctatctcttttagttcattctctctcgttaatacagcaatacaatccagtccttcctgcttccttaccttctttttttcttttaaagttttctttctctttttaataagggcaagtacggggtttaatcttgtttttttgaattctgtgatgctatcatttaaatcttttaaacggcgatattcatcaagcagattctgattctcaacctgaatcgtaactcctttacgaaaactgtttccctgtgatttctgagtatgtgccactctcacaaatgcattagaaaagaaagaagcattcggaagccacacaagaatccctctgtcatcctctagtctgtttaaaaagcaataatccgtatatggctccctgtgcatagattcatattttccctgtatactgagattcatttctttatattctgtatagccacaggcattatgcaatgcaccaattactgtggaaaacggaggcaggggataggtcatcttattctttatcgtttctggttttctatagtttgcactggtctgttttattatcagacgaaacgctttcatcctatggcctccctcctacttcatcacatcaaaatatgttttaacgtcttcaccaagtttgctgaaaaattcagatactcctatcgtttgcagcttttcttctatttcatcttcatttaacaaagcctgtccctttaatagtccagcataaaatccctggttcttcttttgaattaaatcttcggatagttccaatttatcttcttttacatgtactacattctcaaagtaatgcgtttttctgtcagacaaacctccgacaataaaaattggttccgcattatccagattcccttttacaacaaggctcagattctgtattgcattaagcaaaagtattactctttctgctttttcctccggtaatgcctccatattaaagttcttatcttttcctatcatctccagatcaaccgtaatactgtaacattttaatcctttatcatactcatactgatatggcatcagtcccaccttatccgcattgttttgaacatttaatccatttgcctgtgcatagttacttgccagatataaattattatgaaaacgaggctcgtttacaaagctttcacaagaaatcgcatcggtaacataaatagaactgttgcggatatatgtagtatctattgtgttcatataaccgccttctaacgcccggcaatttgctgcattcaacttctcacttactgccttctgcaccacaactttctgctttgaattatccgaaatcgtctgcaaatcatcgtataatccagcctgtaccataagtgcatttttcaaactttctctgcttcgtatcgtataaatctttcggtttttaaataccttctgtacacttgctatatttccaagattctctgcgtaatttgatgtcatatttgcaacaactgtaagagttaacgcttttttcttcattttttaatcccccatttatctattttgctttttcgctacccaatgcttttttatctggtgctttgcccaatgcatttacaaaggcataggcaatgtccatatttttctcaaaatcttcaaacagatcaaatgcaaaatcaaatatcatatctgcataattggccaactgcacaagaatatttaaatatcctgtataatcttttaaaataagcgtactcgtcaaccgctgcctatatgttctcctcttattttctggtaactttcttataagttcttttgcacatgcaaaggctgatctttgtcctttttccatcgcagcttcactcccctcaatatactgattcaactttatcaatgcgtcaactaaataggctgattcttctcttagaaaaaataaaatcaattcatccgctctctttaaattcaaaatgcagtcaatcacttccttctgaatatctaaatcataattttcccgcatttttcttttaaagcaaaatgatttataatgttttttaaaatctcgcaaaacctgaatgctatgctctctaataaataacgtctgaaaaaaatcattgggcttatcctgtgtaggtcgttcctttaaaataacttctacatcataattgataaaatctgccgactcctgcatcgcccgaaataaaattttccttgcatcccgtatttttttaccttcttccgtccgctcttcttccatcttttccgcaagcaaatcatttgtatgtatcagttccttcacggaataactgtcattcacaaaaaaagattcatattcaccaaaaaatccaaatggaacaaaatccaataatatagaatcctctaccacattaatattgttattaaaagcaaatgcagctcctctcgactttctgcccggatcaacgtaatatccctgcaagcgacagcaaacgtctgacttttcttgaaacaactgactttcatttgcaaaattagcatacatactttttttattacgaaaagtttcccgaataagcaccagacggttctcatctatcatctccaacagttcttcctgattcgaaccatcaaacttctttttagaaaatacttttttcataatagaattttccttcagcaacttgttcaccaaatcaatcatttcctttgaaaattcttttctggacaatatttcttctacctgaacatgtggaaattcctctccataataactctctgcaaatagtaaaaattcctctttcgtaatagaatcactgcaaaacttaatgcagtcttcatctacttcatagtcctcatcttccattttatcccggtcttcaaaatatctgcttaaccctacgattgctgccgaatacctccaatcggaaggttcgaccattatatcaaaaatatcattctctaatcttgtaaccatagtcctcccttctgcactatagcggaaattaactaaaaaatatttattaacatttcatcatccagcaattctataatcatttattccaggtcctatctgtaaaatcccatcttatcttaacgctaacattcctattatagaactcaactcttttatttactggcttttaatttaagcaaaaagttcaattataattgctctattatggaacatagaccgtatccgatagccgttctgctcgaagcacctgcttgataaaaatactgtaaaatcattgaatctgcctctactataaacgtaattgctgatacatcaatcataattccatataacctggatacaactttttttccagaaacaggctgaaacttgatttcttctgctaaccttttaggaaatcccgcttccattgcctgcctcatcagggattgccttgctttctcttcaaactgctcctccccaatcacataatacttatccctgttcgtctctctggaatgatctcttacaaccagtccaccacctggaattgttcgaaacattactcgattgcttataatcacattttccttcacatgagcgattctcttgagtgtcatcgcattcttctcaggaagtgggaacttcttatacttcattcccataaaagccatagagaaaattaatcccgtccgattccgatcatccgcagaaaaaatcatctttagccgcggagttttaagctgtatcctctccccctcatacctgggtttgtccaatataattgaaaaagaataatccttccttgccgtcccaccaaaataccgttcaaaaaaatgtccctcatgcgactgttccaatgtcttctttaaaaaggaaacaaaaattgcgcggttatcggcaggcagcgaaggcttttctaaatcaaatagtagttcaaccctcattatgtgtcacctcctattgaggttatgatagcactgttaggtattgttgtccagcatttattaattttattcaaataattacataagggcagtatactaattttgattttaaacaatataataacatacagcatttttataaatgttttttctaaaattttcttttaaatatttttctatactttttctgtaaaatactttataataattcaacgatagtaatagtcgcatgtcaaatacagagtcacattggaatgtagagtatgtaattatctgcaacaaaattaaaagtagctccatattggaatcggaactctatgattattgactatatgcaaaaagctcccgatactttggtatcgagagctttcgctttgtaattatattttttctttttcatcatggtcattgtgcagatcaatacatttttgattttctcattttatcatgttataattttatctactccatcattaatggacttcccaatacatctgctatttcattaacggtatccctattccatttgatatctcctttaacttttctaatgcataacctgtatatctttctattttttcaaccggttctctttcctgtatcatcatctgtgccatagatatatttctttcttctcttcctaattctttgccctgttctattcccagctctacaagtgcctcgcttaaattacacatctcctgcacctcgctttcaaattctactgtcatcgctatctcaaattcatcatttagtctctgctttttctcttctggtgttatcgtcgcagagaacaatacattcagtaaatctagtatctctaaatcactactcttatccgcatctcccagattgagaactactacctccatcaaatcataatttttttcttttgtataggattctccgtaaattatatcctctaccgtgtgatatttaaatattccattctttcgttttctcgccggatctggacaaatccatatgctgtagactttttctagcttctcataatgttcatctgtaaatacagttccatattgttcggaaaccattcttccacagtaataaaatcctctctttacaattgggtatcctggcgtatcatctaactgtatttctagattaagaatcaaacgaactatttcgttactctttggcagaaaggccggaagacgaatatcataatatattgtatgttcctgaatcgagttggattccgtattcatgccttccactctttcgtctccatctaatttgttatccttatctaattcatcatctaattcatcctgatgtactgcatgggttgatacctcagcttcttcttttaagcagttatcacagatatactgcactccgtattgtgaaaattcttttgtacaggattttaaaatccacgctatgattgccttgtagctcagcaatttctttgcacattcatcgtactttgcacgattccctgctatgtcaattgcctgtgctaaacctgtctgacgaatcatcaaaacacctccaaattatcacattacctctttgcttcccacgctatcgcattatttataaaaaaaactttgtttttaagttagtctttaaacaaataaatagcatttcgattatattatcacatattttttcatttttgttgattttctgacaaattatgttaatttcgtgataaggcaaattattttacaaatcaaaagcaacaatatgataatttagtattgaattgtcttctctcatatttccattatgtctctattttaatgtagaattaatttaacggcagtgacaggcggagaaaaatttacattccattatgtcactattttaatatttcttctttctatctaccggctacctgttacgaacattctaccatatttcacttaaactttctatttgaaagcttcttaactctttatttttcatgattctataatactgtcgataccataacattctaactacattagcaatcaatattttcccattatctatcataaaaaacactgccaaatgaatctgttatctggcagtgttaagaccgtactagagcgtgtttgaaaaacattttaagttgttcattttaaccaaattaatattgagacgatgcatacaaaacctagaaaagtggacgccagtttatcataacgtgtcgctattcggcgaaacacctttaatttgagaaaatagttttctactaaatgcctctctttataaagccaccaatcacaatgtcggtcaaactttgccccttttctggatgggattgttggttctccaccatgagagtagatataatcaagtaatttattgctatcgtatccacgatcagctaatacgttgcttccattcgtatttatatgttcaagcaaagggattgcgtaattgatatcattacgttgcccttcactaatcataaaatatactggataaccataagcatctactaccgcatgaatttttgtgctggccccacctcggctgtgtccgatttcgtttggagacccccttttttggcacctgcactatgttgatgagccgaaacaatagaggcatccatagataattctgttaattcagcctcaaggcttagaacacggaaaatgttatcaatgataccatcgtcaatccattttcgaaaacgggagtataccgtttgccatgcaccataacgttctggaagatcacgccagggtgctccactacgagcaatccaaacaatcccgttaagaattgttcgattactttttttaggacggccctgttttccagaattttcaggtggcagtaaaggagcaatgcggttccattcatcgtcagttaattcgtatcgtctcaacatagtaaacaccccttttttctttattttaacatgaaaaagggaattagaatatatgttttgtgcaacttttatttttcaaacacgctctagagcgtgtttgaattaacaactctcattttctactccaactgaaaatacctgctgtacttcataagcgataattcccatcgttgcgattgcatttttataaataggataatgtcttgttgataggaaggcctttgctacggacatcctccaccagatgacaaatgttccatcttcttcaagattaacatcatatttatattttttatcgagtatagttagttccccattatctccacgttcaattccccagttatattttgagataaatcatatccgacatctagtttctgctaaaaactttccaaaacaagtagctttgctatctgaaattctttcttgcatccccactttcctattctttgcatctttatctccgtcgatttatctgctcttatttagcgaaaaatcaaacactttataatagcaactggaattaatacccagccaaacataaaaccaagtataaatcttttgatccacaatgttcccataggaccaataataattttgtttgcataaatcgtctgacctacggatcagtatccaagtactatgtataaaatccatacaattccactaagtgtatctgccataactttctcctcctgtgtgatgtgttgttgttttgttggttttattatacggattggcatggacagaaattgtccatgccataaaaaaataattattcgaaaagaaatctttttactcttcccagagaaccgaatggtgttggagcgtgtataggattttttatttctgtagatgaaagcatagcgcaggtatcttctaaactaaatattctgaatctgtctatccatattctgcttctttatagaaattcgcacatacccataaatctttctcataattttctttctgtatcacaaaaaacgaccattagatttgacacttaattttatatgatttgtcaaacctaacagtctacttttgacactattcatttataggtttcttttgatactgctgacctattctatttcttacagaaaaacgtcagcaatttctttttcgtcatattatcttcattctttgctcacaacctgttcacaaatttccagtatcataaaaccatcaaaaacaacaacagatttttgatagattttttcatactttcctctcttttgaagccggcgttatgtcggtttcttttttatctattagattggattactcattctctataatttcccgtacctgctcaacttccatatctaataaatcacttatctgttctgccccacattcttttctatacatcttaattatagttttggcaacacctttcgcaatgccattttccgttccctctgcatatgcctgttcttttattccctgactcagattacacatatcattcacatcctttctaatgtcactttccaatggaatatcaaattcatttcctataatatcaaacttctcatctacatttaatttagcagataataatgctcccagcaaacgatgaagttcatatctttcttctttttctggaaggtcttctgccagaccaatcaaaacaatatttgcaaggtctatgtcacctttccattgataagtaccgactacactttcctgtgtaaaatgaatataattcatacagttttgtgacatattcatacaaacccatatggaatatactcgttttatatcattataattggaattcacaaattctctacccttctgtgaggaaatcatcctgctgatatagaatactgctctatttaattaaataataactaaataccgtaaaatcctcctcgtttatgattacttccactacatttaggaagtccctttgtatcccatgacattccaatttcatttttccaggttttgctgcctgccagaaaatatccgctctgagcatcgacaatataccatttttcatccactttcacctgattccattgatggcttggatttaatgcctttttattggcatgaacataataacatggtactccaatggcatcgcataaagctttcatccctcttgcatatccagagcactgtgcttcaccatataccaatgctccccaagctgtatttgctccattatactgccagcctcttgtcgcatacttacaattctggttaagataattaaatgcaataaatgctttctcatagttgctcataccttttttgatatagtttgttttaaaactctgaacaactcttcgaacctgcattaactgattgttattaagtgccgggccataaatactgccttttttgtaggctccttttacagtaggctttttcaatgatgctttacatacatatccaaaattgccataaacctttttacctttcacagttccgtaagcacgtactttatagcggtataccttattcttctttacctttttatctacaaatgtaacctttttaccgcttttgattgtcttaattactttccatttcttaccttctgtacgataaatctgatatccttgcgctttgctaacacgacgccattttatctttacttttttcgcatcagcagaataaatatttaaaatctctgctgtatctaatgttactgcaacagataccgttccagacataattttacttccatcgttacatgtgagaactactttataagaataacgatttcccacagtaacagaatcatcttcaaatactacttgtccagctacctttgtattatctgcatagcaagttacctttttcttattacctacagtataccagccttcactgtaagtattccataactccccttcttctgtgaaattatcaactaactgaaatgctccgcctgaagtcgaacggtaaatttcaatcttctgataaccattcattttaaatgttgcctcaaaagctacctgacttccaccatatgcctgaatatttccaatcttcaatgaatttgccgccttaacctgtacagaatttgtaaaaattcctattcctaaagtcaggcaaaacataagagccagcattatgtttttgtttaaaagtttcctgtaattgtgcattgtttttttcattgcttttcctcctccttatttttatatattttatcacatccttcttactacattctatagaattgattttcctttcggcgcaacctttctttttgcctttataatttctttcgtcagctgtgctgcctgctcgtttgttaaatcagaaataactgctactactccattgttcttttttcctgccatgatttttctcctttagtttcgttcttgtttgtgattgtataatagcaaacagggcatctaaatttgtaattgtgatttactatttaattcattaagtaaactatagacgaggccagtgcctcgaataagggatttttgttatattctcataattttcaaaaaatagtgttttttccaatatgctatagtataataattttataggaggatatttatgacaaaaattaatacagggaatgcaaatcgagagtacaaagaccgtttatttcgttttgtctttggtgcagaagagaacaaagcttatttattatccttgtgtaatgcagtaagcggtacagattacaccgatgtagatgatattgaaatcacaacattaagtgatgctatctacattaagatgaagaatgatatttcatttttaatagacagtcagatgaacctattcgaacatcaaagtacttttaatcctaacatgcctcttcgtggtatggaatgttttgcagaactgtatggaatttacattatagaaaataacttagacatttacgtgagttctttacagaaaattctaactccaagatattatgttatttacaatggaacagagaaacagccagatgtagttaaactaaaattatctgatgcctttcaagttccagacgattcaggagaatttgagtggacagcgacaatgcttaatattaactacggacataatcgaaaattattggaacaatgtcagccattgtatgaatacgcacattttattaagctcgtaagggaatactctgaagcaatggaactaaagaaagctatagataaagcagtcgaaaaagccagagaatggaaatgtataggaacgtttttatatcaatgtaaaagtgaggtgagcgttatgttattaaccgaatttgatgagaaaaaacatgaagataatttaataaaacttggtgaaaaagaaggtagagagaaagaacgtatgaaaaatatatgtagtatgctggcattaagtctttcgcctgaaataatagcgaaagcttgtgaagtttctgtagattatgtattaaatttgaaaaaagagttgtaaagtaaggctacgagttaaattaacctaatccatctacagcgagactgtaattaattctgtgtaaactctaaaagagctatatatcctcttggattgatgttaaaataaatatcaattcaggaggatttttttatggcacgaagaagaaaaatggatccggaacgcaaagcgttcatcagtagcttgttggaacactatcaaccaaaggatgcctaggacgtccaggacatgctgaaagacctgctaggcaaaacgctgcaaggtatgttaaatattgctattttttcgtgttgtcctgttttacattttttcttttcagctatatctcccacatgccacatgaacattctcttccacctttctttccgttattatacggattcaggcagacagaaaatatctatccatatcttttttatagttttctgacatttttacaagttcaccagccggagggatttggagaagaaggctgaaggcatagaaatatccagaaaaataaattctgaatttacttaggcagccaaaacacagcccacagagaatataatattccctgtgggcgtctctcctgctacgcaaaccagaagttattcaataattgttccggttttctccagatagccttctaaagctttatcaattgatgtaataattacctttcttccattgcctttttcaaggaaagaaacacctgcttcaatctttggaagcattgtatttggctcgaactgtccttcatcgatgtatttctgtgcttctgctacagtaatatgctctaatggagattcctgttctgtattgtaaccaacacagacattctctacacttgttaaaaccatgaatacgtctgcgttcaacagttctgccattcttccactggcatagtctttctcgataactgcgctggcaccatgaagttctactccctgtgctaacactggaattccgccaccgccgcaggcgataactacctgtccctggtcagaaagcgctttgatagaatcaatctcgataattccctgtggctttggagctgctacaattcttcgatagccgccctctacttctgtaacatagtttccatgtttttcttcctgctctgcttcttctttcgaaagaagtcttccgataactttaactggctcattaaatgcatcatcataagggtctaccattacctgtgtgataattgtacatactgggcgatatactcctctttttaagagttcggcacgaatcgcattctgtaaatcgtatccaacatatccctgactcatagcagaacatacggacataggcgcctgtgtatagtcttctctgtccttactgaattcgttcatcgctgtatggatcattccaacctgtggtgcattactgtgggatataacaacgtctgcccctgcttctactaaatctgcaattgccttggctgtatttcttgttgctttgtactgttctggcattgttgttcctaatgctcggtgtccgagggctattactacttttttcttgctcataattcccaatcctttctacagttatacttgagttatatttgtcttttagtctaccagaaaataaaaagaatttccagagcgtgtttataaaattagtttcctgtaaaagattacaagatgtaaaaaacatttaaatcacgccgactatttctccaaatattctttcattgcttctattgccttttctccgtcatgaagtccctgtttataaagaaccgtaagttttgccttatccttttcaattcttcctacttccacttttgcttctggacgaatgataaagacctttccctctttttcctgttcttctaagaaatctattgtctcattataacggacatgtcttgtctccatagcatgaagaaattctttatactttggataacgaagacgcataatcggcatcagcttattcggcgccttacgatatccgtggtctcttgtgagaatgacaacattcttctcattgccatcttctattgatttacgaatcggaatactgtcagcaattcctccatcaagaagcttatgtccttttacaacgattgtcttagaaactaatggcagcgaacttgatgaacgaatcatccacatctgctttctaagatcgcgcactcttaaatatcttgcagctcctgtttccacatcagtaactactgcataaaacttacctggataatttaaaaatgcctgatgatcaaatggatctaacacatctggaatctgttcataaagcatctctggcccaaaaacatttcctgttttcaaaaatgtttttgctccacagtaattcgggtcatcaagataatctacatttactcgaaatgcccttcctctctgtttagaaaggtagctgcatgcatggcagcttccggcagatactccatatacactggaaaattcaattcctgcatctaaaaaggcatctaatacaccggctgtatatacaccgcgcattccgcctccttctaaaatcaatcctgcattatacataatcgacctcgctttctattttgcattttctttgctgtctttttatatagaacatagtataactcgatttcggtaaattctccacagttattttttatagtgattgctgcgggcatctccttgcctgcggcaaaccaaatttcaccttatcacctgctggcgtttatattcgctgattggttttcttcctgcttttctggcagcaatctgttcatacaagtctgcggttcgtatatctatactgtaaatctgtgcctgtgccgaactgttggaataaagttttttgccctctgcaggacgttggatgatatccaaagtggcattttgacgtatttcttttagcaggggagaagaggatttggaaaagcctaatattcttgcatatggtatcggaatgtctttggcttcttctaagaatggatagtatttcatgtgaagtacgatatgcaaaagaactcttctcaatgccgcatccgtaatctgtctggcgtgaaggccttctatcaaatcttcgaaagaaagtcctggctcataaatattttgaaatcttcttgctaaatcaagattcattccaaagtatttgccaattactttatttttcagaagaaacgtatagtcaagatagggcattaaatcttcccaggtcacaaagttattctgtaaaaatccttctataaaaggaagatattctccacaaagtgctttttcaaatgcctggggtgcttctttttctttgttataagtattattatagatattgctgactctgttattggtattttttcccgtatttccacattttccgctattacaagtttctgtattatacggattttttctactgaagtttctataaaaatggtacatttcttggcggattgctgttgcggaggaatagttttctgtcagtttattttcatgataatgatttccttttcttttaataacaactggcctgatcaaagaatttcttctttttaatgctttgatatattccaagcctaaaatatgatttggctcttttaaaaattctattgctttttctggtttcgaatcgaataataagtttcccgctgcgaaagctctcgcttctggaaaactttttcccgattttaattgttcctgcaaaatctgtttatattcttccgattcttcaagaaataaagtcgcatatgccgaaaaatcttctacttctgcccattcgcttccaaaggaaagataatcgacacagcctaattgatcaagaatcccaatccctgctgtagcaaaatattcggcactggctgtcgcatagattgccggcatttcaataatcaagtctgctccgccagaaagcgccatccgggttcgcatatatttatctgcaattgccggttctccacgctgtacatagtccccgctcataactacaacaacataatctgcccctgtttttttccgtgtttcttctatatgatattggtgccctttgtgaaatggattgtactctgcgataattcccgctactttcataaatgaactcctttctccttttatttctacctgaatgcaattcatctcccaccttagagatcggagtattcttgctgtaagcggataaatctgcttatctttgtccatattataaccgaaaacaaacgaaacagcaatcttcctattttttgtatttcttactattttttatcgttttttgatgaattttttcgatttttttggacatttttatatttttgtctaatcatgttaactttcaaacaaaatcatttattgtttactatgaaatacaattacctatcaaaactcaaaaaaaagtgccgaaataacaaaaaaactccatcataagctgaataagtacattttcaagataaaaaaaacaagctataatatgcctagcaaaataaaataagcgaaatttggcgtttcgtaataaataattatacaaaaaggagatatgaaatgaaggttttagtaattaactgcggtagctcttccctgaaatatcaggttattgattctgagacagaacacgttctcgcaaaaggtttatgtgaaagaatcggtatcgatggtgttttaacttatcagccggccggccaggataagattaagtacgaagctgcaatgcctgcacatcgtcaggctgttgaacttgtattaaaacagttaacagaccctgaaaatggtgtattaaaatccatcgatgaaattgatgctgttggacatcgtatggtacatggtggtgagaaatttgcttgttccacattacttacagaagaagtattaaagacagtagaatcttgtaacgacttagctcctcttcacaaccctcctacattagttggtgttgctgcttgtaaagagcttcttcctaccactccaatggttggtgtatttgatacagctttccatcagactatgccaccagaagcttacatctatggtcttccatatgagtactatgagaaatacgctgttcgtcgttacggcttccacggaacatctcataaatatgtttctttaagagctgctgagattcttggtaaaaaacctgaagacttaaagattgttgtatgtcaccttggtaatggttcttccatctccgctgttgatggtggaaaatgtgtagatacttctatgggtcttactccattagagggtcttgtaatgggtacacgttctggtgatatcgaccctacttgtatcgaattcatcgctcacaaagagaacctttctcttgagcaggttatggatatcataaataagaaatccggtgttcttggtatttccggtgtttcttctgacttccgtgatcttgacgaggctgcaaaagctggtaacaaacgtgctgacttggctttaagagtattttctcattccgtagttaaatacatcggaagtttcatcgccgttatgaacggtgttgacgccatcgtatttacagctggtatcggtgagaacgacgatatcatccgttcaagaattatcgaacatttcgattaccttgatacaactttagatcagaaagcaaacaagatgcatggagaagaacgtattatctccactccagaatcaaaagtaaaagttatctgtatcccaacaaacgaagagcttgcaatttgccgcgatacagttgaaatcgttactaagaaaatggtagaagatacagtgaaagatgttttaggtaacaactaattctttcctattttttatcatatcttcattacttaatataaagaatcccccggaaagttcctcatccgggggattcgatttttattcgggaatgacagaggatagacaaaaaattcaaaaacagacgaatccaggaagataaaatatccctatttgtggctttcgtcgctgcaggctgaatgttcgctttaagcgcccgcatccagcctttgctcccaggccacaaatagggataaatgccacctattcgattctttcaaacaccattgttgcctggatgcggtcaccgcctccaagtcctttacttccaccagatgttgtgctgatggtatgtaaacgatatcctttatccaataaaataggaatttgccgcaggcaaaggagacgccctctggaagataaataaagcatatttgtgactttagtcgctgcaggttgaatgctcgctttaagtgctcacatccaacctttgctccgaggtcacaaatatgctttatttatcttccagagggctgtgttttggctggggatggaattgctttttattgttggagggatttgaggacgctccagaaggttatagctttcgttataactgttttttgaagaattgattcgaattacttctatctctcctgacttcttccccaaatctttccacaaatttgcccgggcagccagaaaacagaagtccgagaatcaaatcatctatatttgtgatttgattctcagacttcgtctgtttactcaccccggcaaattcctattttctatgcaggattctgatggagttgagcaggcacaataccgatactcctgtatcagcaaataccgcaatccacatatttgcgaatccaaacagacccataatcataacgatgatcttgattgcaagtgcaaatacaacgttctgccatgaaatactatttgtcattttcgcaatgctgatggcttctgggatggctttcatttcggagttcatgaatacgacatctgctgcttcgattgctgcgtctgcgccgcttcccatagctgctccaacatcagctccggcaagtaccggtgcatcgttgataccgtctccgacaaacataaccgctccatgattttctctgattttcttcaattcagataatttatcctgtgggagcagttttgcgtgtacttcatcaattccggtttcttttgctacagcatctgcactttcctgtgcatcacccgtaagcattgctgtaataattccctgtttctttacagcggcgattgcatctttggcatcgtcttttacagtatcggaaatgacgatatttccaacaaatttgccatttaaggcaacgagtacttctgtaccaaagttttctttctggtatacacttaagtctacgttctgtgcatccataagctttctgttaccacagagaacaacacctctgctaagttctgcacgaataccatgtccggcgatttcttctactttcgatggtctttcgatagaaagtcccttttcttcagctgcttctacgatgctatttccaattggatgtgtagaagacaattcacaacttgcactgattgctaataaatcattggcagtcattgcatttcctgctggattggctttctgaacaacaaagttaccctttgtgatcgttccagtcttatccattacgattgcttttacatttttcaggctttcaattgcaattccacctttgaaaaggatacctttcttagagcctgctccgattccagagaagaatgccagcggtacacttaatactaacgcacatggacaactgataactaagaatgtcagcgctgtgtaaatagatgcggttccgcttgttccatgaatcgtatttactgttcctgtataggcactgtctacgaagaaatgccagttcagggaatctggtaaaataaatggaagtactactgctacaaataatgcgaataatacaacgaatggtgtgtatactcttgcaaaacgagtaataaatttatcaatgtttggtttacttgccgctgcattttccacagagtcaagaattcttgttaccatagattcttcaagaattttttctacacgaatctttaactgtccagatgtattcacacatccggaaacgatgttgtcccctgcctttgccataacaggtactggctcaccggtaactggtgaagtatcaatacggctctctccatcaatgataacaccatctaatggaatacggtcacccggacgtactaaaaggatatctcctacatttgcttcttccgcatcaataatacggacatcatttccaatgacaagattaacaacttctggtcttaagtcaaccgcttccataatctgagtacggctctgctcggttgctttttcttcaaaatactcaccgatacgatagaaaagcattacgcctactgcttccgggaattcctgaatacagaacgcaccaattgttgcaatacacataaggaagttctcatcaaatacctgacctttcatgatattctttccagctgtgattaataccttgccgccaagaactaaataagcaatcagaaacagggcaaacattggaatggttggtacatttcccacatgttcaagaatttcaccaatgatgaaaataactgctcccacgccgatgcttacaagaggattgttaaaagagaacttcttctctcctgcttcttcagattttatcactttattgtcttttggaacaattgtgattccatcttccattgcatcaattgtctctttaatcatcggaatcatctggtctggattcttagcagaaagtttcatctgcttcgttgcataagtaattgtcaggtcatccacaccatttaatgttcttaactttgcttcgatctttgctgcacagtttgcacagtcaagaccttctaaaatatatacctttgtattggaaatgccgcttagcttcttacgctgtcttggaacaattgttactccatcttcaatagaatctacaactgcctgcatctttggaagtaactctgcctgattatttgctgaaactcgaagctgctttgttgcaaatgccactgatgcgaatccaacttccggcatctgacgaatcttcgcctcaatctttgctgcacaattcgcacagtcgattccctctaaaatatatactttcttctccaaatcttcatctggcatatgacagttacattttgcaaggctctctccacaaacatcacaatattctacataggaattacactgctcacactgacagccttccggatgtccttctacctgatgatggtctacctgaaaatgtgtgtgtgaacgagttgcctgtggttttgccggaccgtgatcgtgatgatggtgatgatcatgatcgtgatggtcgtgaccacatccgcactcttctccatgttcatgatggtgatgatgatcatcatggtcgtggtggtcatggccgcatccgcactcttctccatgctcatgatggtgatgatgatgatcatgttcctcgtggtcatgatcatggtcgtgatggtcatggccgcatccacactcttctccatgctcatgatggtgatgatgctcgtgttcctcgtggtcatgatcatggtcgtggtggtcatggccgcatccacactcttctccatgctcatgatggtgatgatgatgctcgtgttcctcgtggtcatgatcatggtcgtggtggtcatggccacatccacactcttctccatgttcatggtgatgatgctcatgattgtgagtttctgctgctttacgtctgctgcgggttctctcaacaacttctacatctggttccatagactgaattgtctctctgatttttggcagaaccgcttccggatcttctgctgcaaatcgaagctgcttggttgcaaatgtaacggatacatcgctaagctccggcaacttactaagctttctctcaatcttggctgcacagtttgcacaatcaaggttctcaagaatatatacttttctctgcattgtgatacctctctttttgatattatagaattaccccagtacatgttgaaaaacaacaagtaatctacacgctctagagcgtgtttgaaacactctctaggaatcggtatgtgtcatatgtattaatgcttcttccataatatctacaatatgctggtcatccagtgaataaaaaacattttttccttcccgtcttgctcttacctgatgcatcttacgcattacggcaagctggtgggaaactgcagacttagtcatgtcaaggaaaactgcaatatcaccggcacacatctcctgctcctttagtgcatacagaatccgtattcttgtgtcatctgctaaaactttaaaaaaggatactaccttatcaatctcgcagtctttcggcatactcttctgtaccttttcaatactttcaggaaacattgccacacaatcgctctttttcgttcccataacttcctccttcatcaaacaaataattgaatacttgttcaactgtccttattatagttgaacaagtgctcaattgtcaataggtatttttaaattttttctactttttcagtatgatataaattttaaataaatttctattgtaaatcacatggtaacccttactaagtcaaagaaaccttttttctgaaattttattaaaacctgattacatttcctgtgcagttaaaaataaatttttctccaaagttattttttattgtttctaaattgtcctctcccgtacaatgggaaacggcaataaaatttatattcatttcttttaagtcatctattgtctttctaagccgctctccgtcagcttccatcaaatgggttcctccgacaactccgcaaatctttttaccacttctcttttcaattgttctaagaatattcataatgcccggatgagaacatcccactataacgacaatgccttgctcggtatctaatgctacggcaatttcgtctgtgaaagaatccttcgtatattcagatattactttttctattgccggcttcacgctcaattcgtcagaagaacaatcggtactgtacgcagtcattccttcctctgttccagagtgtgtttgaaaaaagctttctgcaaagcaaccagcaacaatttccttgtcttctttttttacaaaaaaacgaggatttaactgttcatatcctacaatgcgctcaaagttacgatataatgttactcccggaaaaatcatttgcatatcttcttttacctcacaaacggttattccttttttctctaattcttccttggaaaatgcaatcccaatatctttcatcgttccatcgtttttctcataatattttccctgaaaaaaatcttttcccacatatatttttctgattgtctcttcttctatgagtcttttcacaccaccagcatgatcataatgggcatggctaattaataatgcacttaaattttcaagagaaatccccattttcgctgcattttcataaaatattccactctgccctgtgtccattaacaggcaaacctgttcctcttgattctcaccttcaatcaaaatagcaagaccatgctcacacatatatctttcctctttatccacatgattttcaatcaacgtagtcagcttccatctcataaaaagttcctccattctctataaatcatgatacaatagatttagatttttgagaagtttttttaaagttaagctgtgactatagtaattccacaattactataaaaaacctatcattataaaatgcaattactacgctatacaactacactatatctcaatactttcctcttttttaagtgtccgtagtgtaatatccattcagtaataacagtttatgaataatgatttgacagttcacaataaaagatgtacaaggtaaactggcaaaattatattcaataatacttttagaaaccaaatggatgaagcagtagttacatctataattacaataaattatttctggaggttttattatgaaacattctcttcatttatacggaactcttggtcctgcctgtgccacaaaagaaaaaatccgcacaatgtttttatctggcatgaccggaatgcgccttaatctttcccacagcaatcttgatgactgtaaagactggctgcagcaatattacgaagtttccgaacgtctgcacatcgttcctgaacttcttgttgatttacagggtcctgaacttcgcatcggaactctggatattccactctccctttccgagaatgatcttatttttcttgtatcagaaaaatcatttgataaaagaaaagaaaactccgctatattttcacgaatcatagctggagaagatgaactttctattattccatgtcctgatattcttttttcttatttcgatgaaggacaggaagtaaaattaaacgatggaaaaattgtattagaattatcggcacctttagaagaagatattttctgtgccaaagtcaaaaaaggcggtgaactgacttcaagaaaaagtattgcaataaaggatgttaccgttcctctgcctgtactcactgaaacagataaacaaaatctgaaattactcagaaaatatcacgttaccggtgttatgcttccttttgtaagaaatgctgatgatttaatcactctccgaaaggaactgtgtgccgacggtatggattatatacgcatctttgcaaagatagagtcgttagaaggtgtagaaaatctgccttctctcctgcctttctgtgatgaaattgttatagcaagaggtgatctcggaaatgccattcctctgccaaaacttcccgccatccagaaacgaatcgccatgacctgtctgcgtgcaaagaaaccattcatggtcgtaacccagatgctcgcctcgatggagcaaaatcctgtaccaaccagagcagaagtaacggatatctttcaggcagtcttagatggggcttcttctctcatgttaacgggagaaactgctgttggggcttatcctgaagaagcgataaaaatactggcacaaacaagtgaggaagcccttcgctttaagatagcgaaattctgatttgtgaggctgcggagcagacgaactcctgaagctaaataaatcctgaatttgcatgggaggccaacaaacagcttccaaagagagccgataccctgtatttgtggcctcggagcaaaggttggatgcgagcggttaagcgaacattcaacctgcagcgactaaagtcacaaatacagggtatcggctctctttggaagcgtctcctttgctgcgcaaatcaggatttatcttcttacttttactccctttccatctcttcccatgagtcgtattttactgaataccaactctttttctttataaataatcgatgggttgtcttcgttttccactccggtaagatatacatgttttatatgatcatcttcctgaagtttcatgccacggataccgatggctccctttttctttcttgtgacttcttctaatggaaaacgtaggaagtatccttcttcactctgcatgataatctgcgcatttatgctgccttctttcgcggcaacgaggcgtactgctgccaggatatcgccttctgcgagtttagtggaagctactgttttcttttgtacgataaattctgctccatcaacaagctttatcatagatgaggctgttacaaagagaagggaggcttcttttaatgttctatctggaacgatgagaagaatctgttcattccggctatcatagtttccgatattatcaagaggagttcccttatctcggagccgtcctgacggaatatcctgtacttttatctgatgcatcacaccagtatcggtgaatacacagatcttatcagtattcatacagtgtacgatatgacggtattcctttaatacagtttcttcatttctctcataagtgtttttatcaagaatcttggagtaaccgaaacgatccataacaaatacaacttctttttcttcgattggcagcgcttttacaacagctgcttttgcgtttgtaagctctgtctttctgtcaaagccgtagttctttttaattttttccaaatcctttttcatgacacgcttcatggaggctggatgctctaaaatatcctgatatttgtctatctttttaagaatttccgcatactcttcctgtaatgccatgatttcaagtccgatgaggcggtacaggcgcatttcaagaatggcggatgcctgcttttccgtgaaacaaagtttggatgcttcttttttcgatttctgtgttttaaaagtgatattttctgtatcaccattaatcaggcaggatttggcatcttttaaacttttacttccacgaagaatctcgataatcaagtcaataatatcacaggctttaatcagaccttctttaatttccttttgttctaattcttttttaagaagagtctcatactttctcgtaagtacttcataatggaactttgtgtggtggctgattatatcctttaaacttaaaagttccggcttaccattagcgatggcaagcatatttactccaaaagtatcctctagtctcgtcttcttgtagagaaggttttctaaacgctctgcatctgcatttctgcgaagctctaatacgatacggattccctctttagaggattcattagaaacatcaatgatatcacttgttgttttattctcaattaaactgacaacatcggaaataaacttgctgatattagctccaatcattgtatatggaatctctgtaatgacaagcttatccctctcggagcgcttctttgctttttcaaaatggacctttccacgaagcttcattttcccgcttccagtctcataaatattctttaattctttctggtttactacgattcctcctgttgggaaatccggccctttcacatattccatcaactcttctgttgtaatttctggattatccatgtaagcttttaccccatccacaacttcagaaaggttgtgtggaggaatacttgtagtcatacctaccgcaattccttctgcgccgttaatcaaaaggttcggaatacgaactggaagaacaacaggctctttttctgtctcatcaaagtttggctgaaagtcaacaacattcttatccatatctgcaagatagacatcctgtgtgaacttctgaagctttgcctccgtataacgcatggccgccgctccatctccctcgatagagccaaagttaccatgtccatcaactaaaggcattccctttttaaaatcctgttccattacgactaacgcttcataaatcgaactgtcaccgtgcgggtgatatttacccattgtatctcccacaatacgggcagatttacgatgtggcttgtctgctgaaagacctaactcctgcatcgcatacagtactcttcgctgtactggttttaaaccatcccgcacatctggtaacgcccgctgacagataacgctcatcgcataatcaatataagacttctgcattacgtcagaaaactctgtttttataatctgctcagacatttctttctccgtttctcaatctgtttgtaactattcaggtttattatacattttcaataaatatattttaaaaagctatataataatcactcttttccggttacatctattcataattttctaaaattattattcctattttataaatctaaatccgcatcctgcgcgtgtgcatgaataaatgctcttcttggtggaacttcgcttcccatcagcatagaagtcacttctgaagccaatcttccatcttcaatctcgacctgctttaaaatacgggtttctggattcagtgttgtctcccaaagctgctcggcatccatctcaccaagacctttaaatcgctgtaaagtaaagttactcttatggttcttacgatagttctccaacgctctgtcatcataaagatattcttccttgcctcgcttaggaatcgctttataaagcggtggtgttgccaggtaaacgtgtccctgatgaatgagatctggcataaagcgatagaaaaatgtcagcaacaatgttgcaatatgggctccatcgacatcggcatccgtcatgattacgattttattatattttaacttggaaatgtcaaaatcgttgccgtaaccttctgaaaatccacagccaaaagtatgaatcatcgtcttaatctctgcatttgcaaggactttatccatagaagccttctctacgttaagaatctttccacgaattggaaggatagcctgtgtacggcggtttcttgccgtctttgcagaaccacccgcggaatctccctccacgataaagacctcacattcttctggattacgactctcacagtttgctaactttccattcgtatcaatggagaacttagacttggaaatgagattcgttctcgctctctcttctgcctttcgaatcttggcagacttctctgcacaggcaatgaccttctttaattcttcaaggtttctgtcataatataaaggaagttcttcaccgagcacttcactgacagccttacctgcatctggattatcaagttttgtctttgtctgtccctcaaatcttgggtctttatgcttaatagaaagaactgctgtcatcccgttacgcacatctgctccggtaaagttcttatctttttcttttaaaatgccaagttctctggcatactggttcataacagaagtaaactttgtcttaaagccagtaatgtgggttccgccttccattgtgcagatattgttgcagaatcccataattgtctcctggaattcatctacatactggaatgcagcctctacctcgatatcgtctacttttttcttaaaataaacaatctcgccaactgcaggcttgcctttatttaaatctctgacatacgcctttaggccttcttcttcatgaaaaaggacggtttcctcttctcccggtcttctattctcaaaggtaatagataatcccggattcagataagcagtctcatgtaatctgctcttaatggattccgccttaaagtatgtcttatcaaatatttctccatctggtaaaaaagtaacagttgttcctgtatcaccttttctacaggtaccgattacttctaacggggcaactgctttgcctttctcgtacatctgctggtataccttaccctcagaacgtaccttaacttctaaccatacagaaagtgcattaacaacagaagcacctacaccatgaagtcctcctgaaatcttatacccgcctgtaccaaacttgcctccggcatgaagcatggtaaataccatctccaccgccggaatgcctgtcttactgttaattcccgtagggatacctcgtccattatcctgaatcgtcgctgttccgtcttcatcaagaatcacctgaatattactgcaatatcctgctaaatgctcatctactgcattatctacaatctcgtagatcagatgattcagacctctggtagaaacacttccgatatacattcccggacgctttcttaccgcttcaagtccctccagaaccgcaatactattcgcattatatgttgtctgctgttccataaatacctcgcaaatttacttataatcgcttcttttctaaactatcttgtccgtccctttttataaacaggtatctgttgctgccagtcaggacaatctacatcataatataatttattctcataaatcatatttatttcaccatttttatattcaaatgctgcagaagagcaatttcttccaaaaggcgtcttccagaactcgctgagagggcgctttgtaaaattaaggataaaacttcttactacgcagccatgtgccacaataagaatattctctgcctttccctctagaggaacaatctcttcctggaaaaattcatctgttctctttaatacatcctgaaaatactctccatactttgcaggacggaaatgtgccggatcaagacggaatctctgataacgaaccattgccggattcgccattattttcccgatgatctttccttctgacgttccaaaactcatctcttttaaacggtcatcacggacaatctctatcgggcggtctcttcgaacaacctgtgctgtcttgtaagccctctttaacggacttgaaaagatatggtcaaagggaatatccttcattccttctgaggtcatctctgcctgctcgattcccttcggagccaggggaatatccacctgtccctgaagcttacttctcttattccactttgtctctccgtgtctcattaaatatatcttcattttaataccttcttctcattctgtaaaaaagcttctgcaatctcctttaacttcattccgttcgatgcttttaataaaaggacatcatctggatgtacataagtcaaaaggtaatcctttaacgcatctcttgactcaaaatgcttcacaacgattctttcgttattatcttcaacaccttttaaaatctcttcggaaagttcaccataagcagcgacctcatccacctgtgttcctgcaataaacttacctacttcatagtgatattctctctctttttctccaagttcaagcatatctgccaacgctgcgattcttcttcctttcacaccttccatagaggaaagaacggaaacacttgccttcatagaatccgggcttgcattatatgtatcatcaattaatgtgcagctctttaaggtatgcatctgctgacgctgtccgtggaaagtaacaagcgctttcgcagccgctttcatatcaagtcccatctgatgagcaactccaagagcaactaatgcattacgcacgttatgttcgcccattgttccgagaacaacttccatatcttttactactttcccttctttatagaagaaatgaaaaatggtctgtccgtcttttacatgcacattctctgctctgtaatcacaggctttatccattccatagaaaaatgtcttatgagataacttaccgcgatatggtgcaagaaacttgtcatccccattaaggaataccataccatcttctggaagtcccttcacaatatccatcttctcaagacagatattctcctgcgtctttaactgtgcgatatggcttacaccaatcattgtaacaacggctacattcgggcgaatcatattcgtaagcttctcaatctgtcctctctcactcatgccgatttcaagaacagcaatttcatcctctctggtcaaatgagaaagtgttaaaggaacaccaatctggctgttctggtttccaattgtctgaaaaaccttcttctgagaagccaataccgtactgatcatctctcttgttgttgtcttaccaacacttcctgtaactgcaacaacaggaagattcatacgatttctgtagaaagtccctaccttctgcatcgcttccactgtatctgcaaccttaatccatggcttattctcaaaaccctctaacggttcgtcatgttctgatgtaaaagtcgcaccgttaatcttaagagcaccatcaataaacttgtgcgcatctactctctctccgataatcggaacaaagatgctatcttcacttccagaacgggaatcaattgaaaactccttaattactttattctcatctccacataaaagctgtccactgcaagcttctacgatatctttaattgttatattctccattactatcttctcctgataatcatacttatccttaaacgactttggaatgtccagcggacattccaacataatatcttacagcaatctctaaatagatgcaagaaaattctctttttcaaacatttgttctggttcattatataacatgataagaaatttgtcaaatcatattaaatcctaatttgccgcaggcaaaagaatagaactcagggagataaataaagcatatttgcggcctcgaagcaaggtttggatgcaagcgcctaagcgaatattcaaaccgccgcgactaaagtcacaaatatgctttaatttatctcctcgagttcgtctccattgcctgcggcaatcagaatctattccggtattgtaattttcccataaattgcagaagtagctgctgtcgcaggggatcctaaataaatgcctactttagatgttcccatacgtcctaagaagttacggttattcgtagcgagtaccttttctccatcacaaaggattccgccagaacgtccacagcacagtccgcagcctggctgtgtgataattgctccggctttcgctaatgtttccatataacctgcttttactgcctcaatataaatcttacggcttgcaggtgttacgattgtacggcaagctactgtttttccctctagaatcttagctgctcttgctaagtcttctaaacggccattggtacaagaaccgataaatacctgatcaatctccgttccgacaagttcacttacaggatgaatattatctacctgagatggacaggcacagaccggcacaagttcttctgcctgataagtcatcacacggcagtaagatgcatcttcatctccataaagccaatctacatcttcgagattcacttctgaatactcacaggttttctcatctggacggaagagacagcacttcgccccagcttcaatggccatattggaaatagtcattctggatgcaacgctcattgcatctactgcagaacctgtaatttcaagtgccttataagtagctccatcagcacgaaggtcaccgatcagacgtaaaataacatcttttgctgtaacattggccggaagagttccattaatcactactttaattgtttctggtacacgaatccacatctctcctgttccaagaatagatgccatctctgtataaccaataccagaagaaaaacagccaacacaaccataagttgttgtatgagaatctgtaccaaaaacaatattacctggctttgcataaccagcttctgtcataagctgatgacagataccgtcacgtctatgtacatgtgttaaaccatatttatctgcaaaggcatcaccaattttaaaatgacgaacatcctctactgcacttgtaggtacaagatggtcataaattaaaacaaccttatctggatcccagagttttgtaaatcccatctcttcaaatttatctgcgacaaaaggaatgaaaatatcatgaatcattactctgtcaacatttacagtaacaatctgacctggagttactttagaaaggccagtatttttttcgataattttttcaattaatgtacttcccatgactgcctcctaaataattccgttacgtttctgcattgcttttacaagaccacctgcattgataatatccatcagattatctggcagcggatgaatcggatatgtctttccatcaaattctaaagactctcccatatttactgtgagactgtctccttctttgattacatcctgaatatcactattctcaataagtaaaagtccattattgatagagtttcggaagaaaatacgggcataggacttcgcaataacacactttacctttaatgccttaataatttccggtgcctgttctctggaagaaccacaaccaaagttcttgccggcaacaataatgtcaccttcctgaatctgacttgcaagttccggtcttaatggagaaaatccatactgcttcatatcttcaacggtaggaagtgccagatattctgtaggaataatgatatcggtatcaatatcatcaccgagcacccatacctttccggtaaattgttccataataatacctctttctgttacataaacactatatataatcttatatcgatagttataataggcatgcaccgtacttatgtactacatagacgatgtaacataattattataaattcgtaggaatctttaatttctaatcttctggtcctgtaatatagcctgcgagagcggatgcagctacggttgctgcacttgccagataaactttagagcttggtgcacctgcacgtcccttaaagtttcttgtacctgtggaaataagcacttcattctcaccgataacgccctggcagcttccccagcatacggaacagttgcagttcataaccattgcaccagcttccattaatgttgtaatgattccttcttctaatgcctgaatatagactgcttttgaagcaggagctacaataaaacgaaccttaggatcaacctgctttccttttacaatttcagccgctacgcgtaagtcatcaatacgtccattattacaagagcctaagaatgcctcatcaatcgcaattttctctttttttacatctttaagaagtgcaaagttatctacaaaatccggacgtacgactacaggctcaatcttacttaaatcataatcatatacttcacagaaatgtgcgtcttcatcactcttaaacatatgtactgcttctcggccatgtgctttacaatattctacaaccttttcatccggttcaacaataccagcctttgctcctgcctctacagtaagattacaaagaaccatacggtcatcaacagaaagattatgcgctccgtctcctgcaaattccataatcttataattggctccattcgctccgatatctccgataatggtaaggattaaatctcttggataaacaccctctcttaacttgccatgtaagttaaaacgaattgtttctggaaccataacccaggaagtacctgttgtcatcgcatacaaaaagtctgtacatccaacccctgtaccaaatgcacctaatgcaccataagatgtagtgtgggaatccgcaccgaaaataagctcacctgggcaaacataatcttccatcataatctgatggcatactccctgtccctcgtacagcttaatatcattctcaattgcaaaatcacgcatcttcttatgcgcttctgcagttttgggattctcagcaggaacgttatgatccataatgaaaacaaccttatctttatctgcaatctttggatttttcaatttattatggtacatatcaacagtcagatgtgttgtaccatcattactcatcatacgatcaagtgtaacagtatgtatatcgtttggttttacaaaatcaacaccggcagcgcgggcgataatcttttctcctaaagtcattcccatgatttacgcttcctccttatttaaagatgcaattaaccctccggcattcagaatattctgcatatattccggaagttttgtacaggaaaatacctgcccatcaacggtaactgtaccagcagataaatcaagatctgcctgtccaccatcttccacatgttcatataaatctttgcatacaataacaggaagtccgatgttaatcgaattacgataaaaaattctggcaaaagacttcgcaataactgccttaattccaagtgcttttaaaacacttggtgcctgctctcttgaagaaccacagccaaagttctcaccggcaacaatcaaatctcctggctgagctttctttgcaaaatcaggatctaaagactcaaaagtgtattgtttcattgcttcaatatctggtaaaagcaggtactgagaagcaataatctggtcagtatccacatcattatgaaacttccatactttattcataaatattacctccaataaaatgttctatttattagaatactacaaattaaaaatgaagtccagaaattaaattgcgaactccccagcttataaacgctagagttggtttgaaaaatgctttctgtaagatgtacgttacaatttatggaatatttttcctgaatgagagcggcgtagctgactacgtcaactgaatgaaaacaaaatataccgcaagttggggcatgcatattgctgaaatgatttttcaaacacgctctaaaggttcctactccaaattataaaaataataaaatgcataattattaaaaatgatattatgactccctctcttccaaaatttacaaaaagaaaatgaatgtactaaaaatagtgcatttttctttcttttttcccttgcttttttctgcaatttcagatacaatttagacataagttagataatgtaattctaattttaaagagatgccctcctctgctggttctttggtatttattttttatatagcatacggggcatctctttttttgcatttttataattattcaattatattgttaagaagaattcttaaatcattatatcagatgtgagatgactcgcatctctcaacaagaatgccgagtcattcttgaatttaggaaaggacataaaaatgggacaattaccacaagatccaattatgctttacagcgttattaacacaaaattaagagacttctattcttcattagaagtattatgtgaagatatgggcctcagtgaggaagaactaaaggaaaaattatcttctgcaggatttgaatatgataaagatagaaatcagtttatatagtattacaaaaacttttttctaattcctgtaatacttcttctgacatctgctcagccacttccattacttcttttatctgttcttttactattccatctaaatgaaacccgccggtacacactgtcacggtgcatccccttatcctctacttctacatctgcttacgtactatcttatattcatcgtccatctggaaatacggacagctatctgatgagccggacaacatccttgccagatcatcctcatccaaattcacctgacattcccctgttccatcttcctcatcgatccaataatatgcacataaatcacattgacttgccataatcaatctccttctcttatttgtaaaattcttacatttatcttatcacatttccaatcgcatttcaacctctttttcacacatttttttacaaaaatttgacttatatttctttctttttttaccaatacttgttattatagtaataatactgactttttcggaatatattattttttcaggaggttttacttatgaaatgtgctattgtcgatttaggatctaatacaattcgtctttccctttataataccctggagaatggcggatttgaaactttattttctaagaaatatatggcaggacttgccggatatgtttctcacggaatcatgtctaacgatggtatcaatcaggcttgtgctgtactgcttgatttcaagattcttctgcagcagctcggcgtaaaagatatgcatgtattcgctaccgcatctctccgtaatatcaaaaatacagagaaggctcttgaaacaatcaaaagaagaaccggtctctccgttgatgtaatcgagggaagcgaagaaggtattcttggttactacggtgctttatatacaaccgatttaaagaacggtatgatgtttgatatcggcggtggcagtactgaatttgtacgcgtaaaaaacggaaaggttaaaaattcacagagtgtctctatcggttccctcaatcttttccacagtaacgtttccggtttatggccagagaaaaaagaacagaaagcaatcacaaaacagattaataagaaacttaataccgtagattttccaaaaaaatctccagaaaaggtttgctgtgtcggcggtacctgtcgtgcgattttaaatattgtaaactatcattttaacaagcaggaaaataatcgcattatcacaagagaagaatttgataaaattttaaaaattttaaccaaacacgatatcacttcccgcaattatattttaaaattatgcccagaccgtgtgcacacaattattccaggtatgatggttgtaaaagagattatggaccgtctgaattgtaaggaattatgggtatcccgttacggtgtacgagaaggatatctttgcaaaaactttcttatgactggctccacacaggaagttacgaaataactttcttctgtaagactccttgaagatttcacaataaatgctataattattaattgtgaagattttaaggaggagaatatcatgacaatacttgaaaaaaggaaattagctccagaacgtgacgagcatttaaaaaaaggagaattcactgttttaaacggagaatattccaaaaattttaacgtgtacgttgtaggtgagaaacataaagaagcagttgattttatcaaagttgctttagaccgttctacagataacgttctgggctttggaattaaaatgggatgccagaagaattttaatgtcatcgtgtgggatgaggaagatattccagaagagtatagagtataattccgggttgcaatattgattagcgatacagacacattatttgtaatcaggtcaatacttgttgactgttgtgtaacatctgtataatcataggcattcgaagtttaatggcattacaatatcttccagtgcaacagaagaacttgtttctttagcaaaatcatattgaacaaaatcgctgcgcgatagcttgcgaaagctacgtgcagcgattttgttcaatcaggatttattcacagtgtcctttttccttgatgacatcaattacagagtctacatatttttcgcactcttcctcggtctcagcctcaaccataacacgaatcactggttctgtaccactttcgcgtacgaggattcttcctgtacttccaagtgtttctgcaacctgttttactgctgcctgtacatcagcatcattctgtgcctctggtttgctctttacacggacatttttaagtacctgtgggtaaatgcgtactggggatgtgagtgttgcaagagaggactttttctctaacataacttccatcatcttgatggctgtgaggattccatctcctgttgttgcatatttactaaaaatgatatgcccagactgttctccgccgatacggtgtccgttctttaccatgttttcgtaaacatatttatcaccaacctgtgttttttcgtaatcaataccaagttcatcaaaggctttataaagtccgaagttagacatgattgttgttactacagtgttgttgcgaagtgcacctttttctttgagatagcgtccataaacgtataaaattaagtctccgtctacgacatttccgttctcatcaacagcgatacaacggtctgcatctccatcaaaggcaaatccaacatcaagctgattctcttttacgaagttctgaaggacttcaatatgtgtggaaccagcattcatgttaatgttcaatccatctggttctgcattgattacataagttttcgctcctaatgcatcaaatacgctctttgcaatcatccaggaacttccgttagcacagtcaagtccaaccttgatgttcttataagaacgtgttgcaagagaaatcaaatatccgatgtaacgatttcttcctgccgaataatcaaccgtacatccaatctggtctcttactgccattgggacttcaatctttccatcaatataatcttcgactttaaggatggtttcttcatccatcttttcaccttttgaattgataagcttgattccattatcatagtatggattatggctggcagaaatcataattccgcagtcaaaatcttctgttcttactacataagaaacacttggggttgttgttacatgtaacagataaacatctgctccagaagcagttaaacctgctactaatgaatattcaaacatatagcttgaacggcgtgtgtcctttccaataacaactttacatttttcttttttatcttttccataataccatccaagaaagcgaccaacctgatatgcatgttctacggttaaatctacgtttgcttcgccacggaaaccatctgttccaaaatatttacccatcgtttttctcctgttacctatcgttctttattaatcttatctacattctattcctgtaattttgtaatatatctacaaaatatagagttggcatgtacggatacattgatattcaaaatcatattctctgcccgtatatccgtacaaatgatttctctattacagatatttgctttttagctttagtatcatagcactattcatgacgtaatgcaacgattggatctaagtttgcagcttttactgccggtaataatccaaatacaactccgataactgtggaaaaggcaatagcaaggattacggccggtatactgatagcaatcggaacattagatatctttccgataatttcagctaaggcaatacctgtaatcgtaccaatgataccacctaaacttgtaagtaccgccgcttcagttaagaactgggcaagaattctattctttcttgcaccaatcgcttttttaagaccgatttctcttgtacgctctgttaccgataccagcataatattcataacaccaataccaccaactaacaaggaaatacttgcgatccaaattaactgtttattcgttgttgcacttacctgctggctttcttccgcagtctcattcatattggctgcacgatacttaatactcttacttgttaccgtctcatttaataaggtctgcgccgcctttccaacggatgtcatattatctgttgaatctgcaagcagcttcgcattctgtggctcatcatactgctgcacaatattccagtcaacatctggaattacaacaataccactggcacttccatcattatatacataggtataataatcttccaccgaattaattaccggactaaatgctgttgattcctcaataacaccgataacgataaatggttctcccttaatatcaattgtctttcctaccgggttggcgtctccaaaaagagaatcggcagctacactatctattaccgcaactttacgatacttttcataatcgctgtctgtaaatcctcttcctcttttcataatgtatccacaagtcccaagataatgggaatctgctccgataagctgtccacctgaaagtgatgtatcattatagtaaatgtagtcaacctgtgtacgggatacatataaagatgcatcttttacatggtcaatatctgcaagctgctggcgcatatcgtcatcaagaaccgggattccttttggaattccatattccatctctgccggatagtttccttcttctgtaagctgcactgttgtcgtgttcgttcctgaaccaatcaggtttttcttaatctgttcatttgttcctttgattgttgatacgatagcaataattgctgcgataccaataatgatacctaacattgtcaggaaggaacgtagtctgtgactccacacaccctgaaaagataatcttatattttcaagcattgttcttcctcctaataaatcatttcgctatcgtcttccgaaatttttgtctttactccttctcttaaattctttccataagggaaggcaatattatcgtcttctgtaacacctgaaacaatttcgatatattgtccattcattgtctttccaatcgttatatactgttttttcaagcgttttgtcttcttatctctaagatacacataactcttcttatcttctgttcgaatatacgctttctgaagatatactgcgttttcgttggccgttcccatagatttcgaactgtaagaaacttcaacactgcctccaggacttagcccatctgcatcttttataaatgcaacgattggataataggaactgtttggattagatacatctccgccattactactgtctgctgtaggaaaatcagaaatttcttttacctctgcagtatattcatctccagtatcacttgatacacatttgatcgttccaccgacctttacactatcaagttccatctcgctgattgatgtttttacatacattccatctgcagcttttaccacgattgcggctgaaccatccgttggaagtgttcccttgctgtacgctgtcgttactgttccggcaagctttgcctttactgttgccttatctacttctgccttagcttctttataactaatctgtgcatcatgaagatcttctttggcctgtgcgatatcatcttccttatcagaaatcgctgcttttaactcctcggctgtatagccgttatcatctccgccgctgctatctgttccgtcatctataccatcgccagagcctgaacctgaaccatcatcggagccacctccattattatcatctccatcatcaccagtatctgcaccttttacaatcagtgttcttgaaatctgctcttttgaaattccttttacattctttacctgtgctgtgattgttacagaagaagacggctctccctcgtccacatacagccagacacctgactttgtttttgtgattgtcgtatcttttgagatattatcactaagcttccatgtaactttactctgatcaatactctttccatcttctgttacaacggtaagcagacatccatttcctgcggttaccctcttacgattctgtttaaacttaatctttttgtctgtagaaggagttgttggattttcatgttctgtagttggcttcgatgggtcatctttcttcaccttactctttaaataagagatggtatatcctgtcccatctgctaattctactgtaaacttgctggaggaagtaatctctaatgtatttgcattctctgtattctcattgtcataatctttttctgatgcgtactcaataaactcggcattaataccctttttaatcaagtcattcaataaagaaccgctgatttttccacctttttgtaaatagaaaatgtatttgccgttggaatctttttgtccatcctctaacttatctgcttttaaatctttgtatgcaggtcttatagttaagttgtcgaaatctgacactttatataatccatcttcctctaaatctgtaaatactctgtctggattatattcatatctgttcttttccttgccgttttcatcaaattcaataaacgtagcatactttttagaatcatgtaatgacttaatgactgaaccttttactcttccgttaacgttcagataataaatataggcattgccagcagaagaaccatctccactagaactgtctctttcactgactgattctatcgaattatgtaaagttcttgaatctccaccttcgtttaacttattaactgtataattatcgttatcataaacattaacttttgtgtctggcgaaagctcaaatgttgcaattggattcttagattcttccgatttatatgagcggaactctgcatattttccttcagaaataagcttcttgacaaacgctccactaatcgttccattttttgtaagtgtgaaaataagtgaatcatcttcttttgttcctgcaccggacgttgcagctttatctgcttcactattaacatgatcccgtaaaactaactttgtctctccagagccggagccactctcggaacccgaaccacttccggaaccactctcggaacctgagccacttccggagccactctcggaacctgagccacttccggagccactctcggaacctgagccacttccggagccactctcggaacctgagccacttccggaaccactctcggaacctgagccacttccggagccactctcggaacctgagccacttccggaaccactctcggaacctgagccacttccggagccactctcggaacctgagccacttccggagccactctcggaacctgagccacttccggagccactctcggaacctgagccacttccacttttagagacagcattcccactctgtactttaacatcagaacttgtaccctctgtatttccattcgcttctgccacaagataactaagacttgttcccttaatagcagaaagattcactgaggcattcataacatcactgtttcccgtatttacggcaccaactgtttttgtatttttaagctttttcagctctttttccatctcggcgatttccattttagaagactgtatctgaagtttttgtaatttcaaatccaattctttctcagagacattatattttaaaagaatatctcctttctttactttatcgcccttttttacatagactttctttaccttctgtccaccatcaatatgaacttcctgtatgtagtctgaagtaagagttcccgtaagagaagtatctgtatcaaaccagtccgaactgttcagcatacttaccgggaatacttttactactgttttgtttctatttcttataacgacaatggaagtaatccccactgccatcacaagaaccagcgctactgcaagtagtatctttttctttcccttcaaatcagatctctccttcccactcttttacgccaaagtcctgttcgatttctgaaaatactgtatcattcttcgcttctttttcactctgaacttcggcctgctgcttttcttttctttccttgtcttccacaatctctccatcaaaaatatggagtactttcttcgcatgattcgcaatattggcatcatgcgtaatcataataatcgttactccctcttcattcaattgctggaacagattcattacctgaataccagaacggctgtccagtgctcctgttggctcatccgcaagaataatctttggattatttaccaaagctcttgcgattgctactctctgctgctgtccgccagaaagctgactcggtctaaaatgtactcgctctgctagccctactctctttaatgcctgaaaagcaatttcctttcgcttttttaccggcactcctgcataacttaacggaagggctacgttgtcaagtgatgtctgttttggaagaagattgaaactctgaaatacaaatcccaaagtattcaaacgtaaatccgacaggcggttctcgttataattaacaatagattccccttctaaaagaaattctccctttgtcggacgatccaggcaaccgataatattcatcagtgttgtctttccagaaccagaaggtcccataattgccacatattcgccctcatcaatagagatatttacatctttaagaactggtatgacaatcttatcctgtaaataattcttataaatatgttttagttccaaaagcatatgctatatgtcctttcctgacgggaatccttattccccaaagtccgcaatatcactatcacttgttccactgttaccagaatctgagctatcacttccaaaatctgcaccgtcactcagacttccatcatcagagctgtcatatgtatccgcactatcactgtaatctgaataatcctctcccacatctgaagtatcttcagatgcatctgaaccaaatgactctgcatcatcattctcctgctcatctccataaccagatgtattatcttccggacttacctttgtaactttcatgccttcttttaatgtactgtcgtcacatgcaatgtaatcacttgttttaaggccgctctttacttcatactcatcaagattctcatcgtactctccaacctgaatctcatgaagctttaacttattatgagaatcgagccatacatagtatttgttattatttttctttatgtaagcagatggcagccacataccctctttctgctcgtcctgtccattatcctgttctataaggacatgctgtcccatcatcaaatccttatcattatctaacttcacataaaagttatacttagaggcagtttctcctgtactgctttcatcatctgtatagccatctgaataatcagagctgctgtcactggtatcatctgccgtcgtatccgtcttaatgctgctgattgttcctttccaggtctgggaattatccactcttgaacgaacaataactggatctccctcgttaagactccatacattcgtctcactgacagttcccttaattcggtaattacctaccgcaagaattgtcatgtaagaggaatcatctgaacttccatcaccagaatccgagccgtcatccgaactatcatccgaagaggaagtctctaaagatgcatttactttctttacaagaccattcatcttactttttactgttgcatctttaatgttcttctctaacaacttaattgactctttattggacttaatcgtatactgatcttttttaattgttgtctgagccgttaaaatctgtgtctgaagctgaatcttctcactggcacttgcagacttcaaatcagactgataagacttaatatcctttgtcaactgtgtaatctcattctgtaaagtctcctgctcaagttctttcttttctttagaaagctttaactcctgtgtgttgtacttaaagagcttatctcccttctttacctgatcccctacattaacatagcgtttctctacagataaatcagactgtaatgtaatcttccatgacttctctgcatcaacagttcctgtataacggttattcgcaccaccagcagttcccagtcctgtaatctcacgaacagactccacataagccttgccctcacttgttcctccgatattgcgaatcacaaaaaaaacaacagcgatcactatgactgctgccgtaccacagataagcgccagcttcttcttggaaaacttcttcttctccggctcctgcaaaataatggcatcgtcatcgcttaacagactttcttcctcttccttagtaccttcaagcttctccgtaccaccagatttttcctcttctttcttcttgcgatggaaaaatccccgtttcttctctggcttctcttcttcctgtaactcttctaattctttatcatattcgtcttcatcgaaattactgtcatcctcgatatatcccatatcgtcctcatacagattgatttcttttttctttttcctgtggaaaaatcctttcttctcttccttatcatttgtggatgaatctaaattcgtctcatccataaattcctgcccattcttcttccgaaacataacaacctccttaatatcttttataaaaagcctagagtatgtttgaaaaatcattcctgcaatctgcacgccccaatttgcatttttcaaacacgctctggcaaagctttaagatagtcacttgaaacttattttgttatgatagcacaattactctgaaaaatcatcaaacatcacaataaattaaaagaatgttcacaattacggaacatttttatattctgcatgttctgtaaaaagaatcttatttaaaaattcttaaatctgcctgagaatattgtaccacatcttcattatacatggtagaaggttactttgacttcttaatatttattaagaatattttttgaattctttctactattttatccaattattttactcagtaaagcacctaacaattgtatgacgaagtctctcacttaattttctaaaacatttgacattctattcttttttctttataatacatagtggatttttatggttttctttacattataataaatgtaaaccattaatttaggaggtaatttgatgaatcaggtatatgatgttattattattggctgcggtgaagctggtatttatgccggttacgaacttagtttaaaaaatccttccttaaagattggtgtttttgaacagggaagggatatttataaaagaagctgccctattgtagcaaaaaaggtaaagcagtgcatcaactgtaaagtctgcgatactatgtgcggctttggtggtgctggtgcattttctgacggtaaatttaactttactacagaatttggcggctggcttactgattatatggatcatgatgaagttatggaactgattcattatgtagatgatgtaaatgtagctcacggtgctactactagctatttctctacaacaactccagaagcacaggctcttgcaaaaaaggctcttgaattcgaccttcatcttttacaggcacagtgcaaacatcttggtacagaaaagaatcttatgattcttacaaatatttatgaagatttaaaagataaaatggatttccattttaatactgctatttctgagattaaaacctgctcagaaggttatgaacttgtaacagaaaaaggggatgtcgcacgttgtcagtatttaatcgctgctcctggacgaagcggtgcagaatggtttgcaaaccagtgtaagaatcttggaattaagcttattaacaatcaggtagatatcggtgttcgtgtggaacttcctgcacgagtatttgaacatatcacagatgtcgtatatgagtcaaaacttgtctaccgtacaaaacagtatggtgacagcgtccgtactttctgtatgaatccttacggacacgttgttgctgaaaatgtagaaggaattaacacggtaaatggtcattcttactctgatgcttctcttcgcagtgagaatacaaactttgcccttcttgtttccaaccgttttacagaaccatttgatgagccatatcgttatggtaagcacattgcttccctttctaatatgttagctggcggcgtgcttgtacagcgtttcggtgacctggtaaagggtatccgtacaaatgaacatcgtttaagccagtctttcgtaaagcctacactgactgctgctgttcctggagatttatctttggcacttccaaagcgtcagcttgatgatattattgagatgatctatgcccttgataaagtagctcctggtactgcaaactatgacactcttttatatggtgcagaagtcaaattctactcttcccgtttagagttaagccacgaacttgagacaaaacttcctggattcttcgctatcggtgatggcgcaggaacgacaagaggacttgcacaggcgggggcttccggaattaaggccgcaagagcggtactcgcaagactttaaatcctgatttgccgcaggcaaagagacgctcacagtaaataaaagtggtatgctcccttttaggtagacagttaaaaaaataaaactgtttatctgaaaggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccaaaagaacctatatttgtgactttagtcgctgcggtttgaatactcgcttatacacgctcgtatccaaaccttgctccgaggccacgaatataggttcttttatttactgtgagctgtctttggctgctgaagtaaagtcagaatttatgttttattgaattttgtgactttgtgctgcggaattttgaccatagaaacttcggactgctttttccgaagtttctgttttattgggcaaaatggagcgtttagcacaacggaacaaaatcaataaattttttaggacttcttctcgttaatccttctggcaatccgattgtttgttcttctatagaggcgtctcccttgcctgtggcaaattctatttatcgtattcttcgtagcccttatagagctcaaattcctcaataatagattcttccggtgcctttgtcatcagactcactaccacgataaacagtaagctgataataaatccaacaacgagagaatataatcctgttgctacatatggagtctgacctccgataatcgggatataatcccagataatcacggttaaagctccagaaagaagtcctgcgatagctcctggaaggttagttctcttccagaaaagactcattactactaatgggccgaaggcagctccaagtcctgcccaggcatcggatacgagtgccatgacggagctgtttggatcccatgcaataatgaaagcaagggctgcaacaataattgttgtgattcgtccaatatttaatacttccttatcacttgcacttggtttaaaaatcccctgataaatatctgcggatactgaggatgagcatacaagaagctgtgaatcagctgtggacatgattgctgctaagataccacagataaagagacctccaataaatggaaggttaatcttatttgtaaatgtttcctgaatcatctggatgaatacagattctgtagatggtgcgcctgctgtttctccaagaatcattggaagaaggtaagctcgacctactactccgatcactacagcaagagtaagggaaattactacccacacgattgcgatcacagatgacttacgaagttctttttcattcttgattgccatgaaacggatgaggatatgtggcattccgcagtatccaagtccccaggcaaggttagagataatctcaatcggtgtgatagcatgatctccgttgtacataagactcatataatgctcagagttcacaccactttgtgctaataaagaggagaaatctccacttacataaccccatgcgataatcggtacaatcaaaagggcaataagcatcattgttccctatacgaagtctgttgtacatacagcgaggaatcccccataaatgtgtagatcaggataacagctgctccgataaataatgccacatgataatcaataccaaatacggtgttgaaaagctttcctcctgatgccagcgcagaagcggtgtatactaagaagaaaacaacgataatcgcagaagagattcctaacaaaatcttcttttcatcatgataacgattaccaaaaaattctggcagagtcattgagttatttgctacgatggtgtaggcacgaagcggttttgcaatgattaaccagtttgcgattgttccaagtccaagacctatagcaatccatgcctgccctgtacccagcgcataaatggaacctggaagtcccataagaagccatccactcatatcggatgcctgtgcagataaggctgcaactgggccggacagtcctctgccgcctaagaaatagtcatcagcccctgttgtttttttcatacaccagacgccaattccaatcatcagcagtaagtacacgccaaaggcgcataatattgcggttgttgttgacatactttgtcctcctgtttttctttttatttattcatcatacaaatttttgtataacaatctcactttatctttatggaattcgtattcctctgactgatttaaggtaatattttcattcgtcacgctaacttgatgaacggtaatcttatccccttcttttacagcacttttgggaatctctaagacactgctactctcttttttcgaggcagcacgcactccatttacaaagacacggcttgcatctgtaaagttatttccaagtaacagataatcatctctgtcttcttttatctccgtaatttctacaggactcaggctgtagttaatcttcgtcggctctaaggactttttatcctctcttacaaagttacttccataaagcatatcatattgtaaaagctttaagtttttacggtatttcttatcctcttccattgtctgatggtattcatttaagaatccattatgaattcctacttcttttaacactttagacgcaagctgccaggcttctactttcccagactgcttctttttattctctttgttatatccaaagttatcccagataaaatatggtgtctcatatttggaattcgtttttaaatctttgctttctaaattcattcccggcaaatggtctccgtatgcgataaccattacatcttcatgataatccgaaagcttatccgtcaaatctttaatgaaatcatccatctctcttgtctgatttacatagtatgtaaactggttaagataactctgactcattccctcaccagaaacagtaatcggagaaccgctctggtcatcagtcggataatctccatgcccctgcacagaaatcgtataaataatatctttcttcttcgtctgatttaatgtatccataatgtacgttgtcagaatagaatcctttgcccagcccacttcattcctgctctttacatccatattttcaatggtaataaaattattaaatccaagattggaaaaaacagcatctctgtcgtaaaaagaagcattattattatgaatcacactggactcataatttttctcctttaaccagtaagcaacactgtcacaggttgtcttgtggaggatacttcggtatgggtactctcctgtaccaaagtaatccatgttcattcctgtaatcacttcaaattctgtattaattgtccccgctccatatactggaactttcaaatacccggaggtatattctttctgaatcttatgaaatgtcggaatcgggtcttccgaaacttttaaattctttacggttgtcgcatcgaaaaaggattctaactgaataaaaataatattcggttcccgtacatcttctgctttttccgattgtttttgcttcttttctgcctttttgacctttttctttataccttttaccgtatctctcgaatagttgatcgggcggtcaattcctgtatctatcgctgtcacacaaaatccataggcaaccccataatctttatatccagctatcaggttatcaaacttcttgataagcattcccttgccgacaccgacatatgttactgcacaaaaacacactactgtaactgctgtatataaaaatccggagaaagcacttttaaacttcttatcctccggcgaatagaggtaaagacatacaagacctcctactccaatcaccagcaaaataacaatcgctacaatctgccatacctcaagatagctgctgagaatcggcagtaccgacttcactaacgtaaggtctaccgctgtaaacggtgtctttctgtcacttagcacaatgccattcgcaatcgccacaagactccagcagccagtaataaatacatacgcaaaaatctttttctttactaaaaatacaaccgataaacataaaaatataataaatccattataaagaaatacaaatgttctctcctgaacaaacgagaacacctcacttactgatcttctctctgtaaattccaaaagaagattcagacagagagtaagaatcagattaagaatgagaactctgcagtttgatgagtcctttattctctcccatatatttttctctcccatagttactccttgtctattcctttgctgtcctttgtatctgcattgcctgtacaataaatcgtccggcttccgaagaagaagtacaggtggacaatgtcaacatattttctgtactgcctgtctttgttccaagatgatagagcgacttttctactgccgtctttaaataatctgcatagtcctcttcggtggcaaattctattgtatagacatcggcatctacattcacatcaatttctcttgccgcaaaaacctgatactctatctcttcttgtggtgtgataatccatatcttctgatggtctttataatcggcatctgcattataactggtatcataattcttctttaacataccaaacatctgaccattcttcaagttatgcccataaacaatactgttttctgaagaaaaatctgcctcacatcccgcatctaaaaagatagctccaataaaactatcctttccttcaaaggttctgtgaagataggaagtattgtccgttgtctggacaatcggataattaataccagttcccttaatataaatccatgcttttacatcaggatttatcctggcaagtgcatcaaaatccacctgaaccggacaagtatccggtcctgactttttcttcctctttttatcagaatcctttttttcctttacatactgccttaactgctcatactcttttcttccaccatgataattattgtaatatccccacagtttccacgcagcaacacaaaaaacaacaatacacaatagaagaagcagatttgagaaaaatccgctcccttttctttttttctttctgctcataagcacacctatttcagacgaagaggcagtccgctgatggctacataaacttcatcacttaatgaagcaagcacctgattggcctttcctgaaatatcactgaaaattcttccaagacggtaagatggtacaatgctcattcctacttcattggatacaatgataagtgttttatcctcatcacgaattgcctttacaagattggtcagttccttaataacctcactctcaagcttctccacctcagaagcagaaatcttatcgaaatctctctcctcttcttcgaacaaaatattcgtgatcataacagtgacacagtcaagaagaatggtattcttttccgtattttttacaacctcaccaagatcgcggtatccttcataagttccccattccggatcacgtcgctcctgatgcatacggatacgctccttcatgtcatcatcaatcggaatcgctgtcgcaaggtaaagaacactgcgcttgccatattcctttgccttctgctctgcaatcacgctctttccacttcggcttccaccggtaaccataataacctttgacataactcttcctccttaaaatatccgggataattcttctcaaatcccccggttacttaaatatttcaggttgcttgaacattttgtataaaatattgcacaaaatagattcctttgaaaacgctttattccttcgaaggttgtgggtcgaggacagaaatctcgccccgcataataaatcccatcgtgataaatactgtcacaatcataagcacaaaactatctatcatgtatccaagtgctatattcgcgcttccgataaccgccgccagcgttctggcatagaccgcaatgtaaaaggactctgccattgatacaatcttaccctctgtcgttcggacacttcccctgcatataagggcaaatgccaacgctaccaaaagatactgtactgccttcgttataagaagtaccaccaaatagaatacaagaaacatataaaatgctggaagcatctctgctaatcccttattattcaacttccaatttttaaactgagaaagtacaatctgctgatttccacttggcatcttaattaaaatgttcttctttccaactaaaagttcctgtacataatcagatttaaaatccgactccttaaattcttcaactgacgaatctgccttgatatgaacaaccccgcctattgtaaaatcaatcggactctcactctgaaaatatcctttttctaaagtaaacttcgggatacggtttaaaaccagattttctaaaccaccgacactcgccgtccatgccgcaaatggaatcacattctcgataagtacgagaaacatgacaagcacagctacataaccgacaaatgctccctttttcttcttaatcagttctttatactgagatggatggatgcaggcaatcacatactgccacaaaaatccaatcttactctcctgctgcatcatcttcccctataccggatatacaatagaggcggcaatctcgtctgccttttctttgctaatcaatacttcaattaacttcagtgcaaatgcaatcgctgtacctactccccggcttgttactacattaccatcaacagcaaccggctcttctgtatactctcccacaggaattccgtcaagacatcccggataactggttgcctttctgtcctttaaaaagccaagtccgccaaatacagatggtgccgcacagattgctgctacccacttaccagcctcatactgcttttttaaaagttctgcaagaccctcatggtctcttaaataattcgttcccggcattcctcccggaagtacgagcatatctgcctcttccttaatatcttctattaaaatgtctgtattcacagaaatattacgggctcctgttatctttgttcttcccataatggaaaccatcgtcacagaaacaccagctcttctcaataaatctactgccgtaagtccttctacttcctcaaaaccatcggcacaaaatacatatactgaacgcatcataagcctcctttactttgttaataaattcattatccttaataatatcctacttgcacctttttatcaagcttggtcatacttttttcactttatttctcctaaaaatatgatattatatagtaatacattgttatcgactgttattttttaattaaaataatattttagggaggatgaacatggaaattgaaagaaagtttttaataaaatctttacccgacaatttagaaagttattcctgtgatactttaattcaggcatacatttccacagaacccgttatccgtgtcaggcaaaaaaacgaagattatattctcaccctgaagtctgctggattactcgccagagaagaaattgaaatgccacttacagaagaatctttcaaacatctgctttcaaaaaaagatggcatttctatcaaaaagaaacggtataaaattccagataccccttacttaatcgaacttgacgtattcgagggcgattacaatggattttgcatggcagaagtagaattttcggatatagacagtgccaatgcttacaatgctcctgcctggttcggcccggaagttacaatggattcccgttttcataattccagtttaagcaagagaaatccagcggaagttcaggaatttctggaattaatccagaagatgtaatatgattataagaatttcgaaattgtaacacaattttaagaataattaatatcatttttcttgaaaatgtattataatgttactgttttgtaactctataaatttatatagtctagttacaaatccgggtcacacaaagggaatctcataaatatgattcttttgttcttttgtaggcaaaaccactatcttcagatgctggaaattgactataatacagcccacgcgcaaatctactgcgcgatttatcattaaattaattttaagaaaggagattattcacgaatgagtgatacacagacaacaaatgtcacaccagacagttcaacaacaagaaaccgccgcagtgacaaaaagtcctctaagacaggtaagattgccgcagccgttattgttgttttacttcttgccgtttacggcggtggtgtttactattattccagccattttccacataacacattaatcaaccatgtaaaagtcggggagatggatgtaaccaaagctgagaaaacatttacagatgaccttgcatctcataagatttctttaaaagaaaaggaacgtacagaagttattgatgctaacgatgtcggaacagtcatcaatgtcggcagccagatcagtgacttacaggattccatgaatccatggttatggttcacaaatctgtttggttccaaacactatactgttaaattagatgtaacttacgatgaaaccaaattggaaaaagttattaataatcttgcatgtttcaaaaaagaaaatgtaactgcaccaaagagtacttacataaaagcaggagacagccagtttgaaattgtccctgaagttcttggtaacactgtaaagaaaaaagctctcatcaagttaattggaaaggacctttccacaggaatcacaaagattgaccttgaaaaagagaatctttacaaacttccaaaatattatgcaaaagataaggtcgtaactgatgccctcgcaaaagcaaacaaatacgctggcggcactatcacttatgattttgattacacaacagagacacttgattatgaaacatccaaagactgggttaaaatctccaaagactttaaagtaacattagacgaaagcaaagttggagactatattgaaaaactcggctccaaatacaatacaatgggatcctcccgtcctttcactaccgcttacggctctaagatcaatgtatacggcggtgactacggctggaagatttatttcgataaagaaaaaaccaaacttatcaaagaaatcaagtccggtaaagatgtagaaagagaacctgtatactcctacaaagccaaatgcagaaagtcagctaaagatgatatcggtgactcttatgtcgaagtaagtatttccaatcaggaaatatggctctacgttaacggagaatgtaaagtaaactcctccgttgtaactggtgacccaacaaggggacatcagacttatacaggcgtttatgcaatcacttataaacaaaaagatgctaccttaacaggaccaaacgctggtggcggctcctattcctctcatgtaaacttctggatgccatttaatggtggtcagggactccatgatgcagatagctggagaagttcttatggcggttctatttacagaggaagcggttctcatggctgtgttaactgcccttattctaccgcagcgactctttataaatatgtagatgcaggattccctgttatcgtttactaaacagttaatcactttttatttgttaatgacataaaatatccccaccgggtggagtgttgctctacaatggtggggatatttttttgatttgccgcagaaacagacgaactccagaagataaataaagcctatttgtgactttgactttagtcgcggcggtttgaatgttcgcttatacgctcgcatccaaaccttgctccgaggccacaaataggctttatttatcttctggagttctgccgttggcagcttgggaaatcagttagggggagctttgaggaagatgacaggagatataaaaattccaggaaatcaaaacttattggattgactcttaaacgattgtcataatagtatagcattttatcctcttacagcaagaatactccgacctctaaggtgggagatgaattgcgtctgctacccacttgatagagtatcctaattatagtatagtatctttagtcggataataaaaaattgagataataacgcacatttagtattcttactatactagcatcttgtgcttatgttcaagtatcgcaggcggtttttcgcggaaaaggaagtggcatggtggcaaacagagcatataaattcagaatctatcccaatgatgaacagaagattttgtttgctaagacttttggctgtgtgagaatggtatacaatcattggcttgatagaaagattcggcagtatgaggagaacaagacaaacgtaacatataccatttgtgcaaaagaaatggctgcaatgaagaaaacagaagaatacggatttttaaaggaagcagatagtatcgcattacaacaatcgctcaggcatcttgatacggcatttcagaactttttcaaacagccgaaaacaggttttccaagattcaaattaaaaaagcggaataaaaacagctattccacgatctgcatcaacggtaacataactctgtctaatggatatttgagattacctaagattggccaagtccggttaaaacagcacaggattattccaggggaatacagactgaaatctgtaacagtaagtcagacaccaagcggaaaataccatgcaagtattctttttgagtatgaagatcaagtacaggaaagggaactgcaaaagtttttggggttagatttttccatgcatgaattatatcgtgacagcaacggtaaggaacctgcctatccaaggtattacaggaacgcagagaaaaaattagcgagagaacaacgtaagctttccaaaatgcagaaaggttcaaacaatcgcaataagcagaggattaaagtggcaaaacttcacgaaaaggtttccaatcaacgaaaagacttcctgcataagcagtcaagacagataaccaatgcctatgattgcgtatgtatagaagatttagatatgaaagcgatgtcgcggtcactaaattttgggaaatctgtttcggataacggctggggaatgttcacaacatttttgagatacaaactggaggagcaggggaagaaacttgtgaaggtggatagattttttgcaagcagccagacctgttctgtttgtggttacaaaaatgcaaaaacgaaaaatcttgcgttaagagagtgggattgtccgcagtgtggaacccatcatgacagagatgtaaatgcggcggtaaatatcagaaatgagggaatgcggctggtaaatgcatgaccttaacacaatataacacaaccgtgggacacacggggatagctcgcttatgcttagcacagtagtgttatcgaacgagaaccaaacttgccgaggtgggaagcacccacctctataggacgccactgaaaaactaattttacatgcaatatatagtattgtaaaatcaacaaacatactttattttgtattgatttacacgtaaaaaggactttttcagtgacatcctataggtgggggaggatgtcacaattgccattttctctatataactcaaaaattgagattgcttatagtttatctctcaaaacacaacttcaccaaccaaagacagcccacagaaaatgaaataatccttatttcattctctgtggtcgtttcttataacacatgatctatggttgctactttttcccaaccaaagcacagctctcagtaaataaaagaaactatatttgtggcctcggagcaaggtttgaatacgagagtgtagaagcgagtattcaaaccgccgcgactaaagtcacaaatatagtttcttttatttactgagagcgtctcctttgctgcgcaaaacaaatccctaagctttttttatgaatttatttccacattttggacaggtaatctccacctttccctttccttttggaactcggagtttctgcttgcaaactgggcatttgaagaagcgaaataacttggcctctgcctgttcctcacgcttttcaataatattctcacacaatggacgagccagcttaaggaagcattcattttcatgcgctcttctttcatggttgcgtgaaaatacccgaaaaatgcagcctaacagcggaagataactaattaaattaaagttatttactgcctgcgacggccacatgcctgtaaccagattcaggataacactaatgaacagcaagaagctggacattccatcaaaaccgtatatttcatcaaaaaaacttcctaaccgtttcatccccaacaatctccttttgtctattgaatcagtgaaaagaatccggcacttaatgtcatcataatgactccggcaagtaaaactccgcacatagctgcgagtacgcttgatttaaagttcatctttaagaaacttgctgccagtgttcctgtccatgctccagttcccggaagtggaattcctacaaataaaagtaatgcaacaaagagtcctctccctgcagttgcctgtaacttttctccgcctttttcgccttttgctgtgcaccagcggcagaacttaccgattatacttggcatattgcttccgatttcgagtacctttcttgcaaataaatagataactggtactggaagcatatttcctatgattgcaatgacataagaaggaatcagtggaagtcctactgcctgtgaataaggaatcgctgctcttagttctgcaatcggaaccatagaaattaaaaatactgttaaataatgtttgatcatcttatcttccttttttatttttttactattccaaatcatacaattacagacaaactatttttctttttaacccaacggtattttgaaaattagtagttcggatagttatatccaaaattgcctcacttttaagattttgaatgatttcacgaatagcatcatcagactttatgatttatatatctgacagagatttgcaatgtttcgctccaaataatactacacattattcgtcccgtcaattacagtagtttacgaattatgtcggtattggagctttattttatacatacattacaatttatattattttttcaacaaagaatgcttcatcacctgaataaattctttattattttttgtccgtttgaagaagttaagtatctgctccatattttcttctgcgcggtttccggacatttctctgtgaagggcgtatacaatttcctgttcttctttggataagagaaggtcttctcgtcttgttccagaacgctggatattgattgccgggaaaattctcttttctgccagtttacggtctaatacaagctccatgttaccggttcctttaaattcttcgaatacaacgtcatccatcttgcttccagtctcaacaagtgcggttgcaaggatagtaagacttccgccttcgcgcatatttcttgctgctccgaagaatttctttggcatatagagcgctgccggatcaagaccaccggaaagtgttcttccacttggaggtacaagaagattatatgctcttgctaatcgtgtaatactgtctaataaaataacgacatcctgtttatgttctacaagacgttttgcacgttctaataccatttcagatactcttttgtgatgctctggaagttcatcaaatgtggaataaatgacttctgcatttggtccctcaatggattctctgatgtctgttacttcttccgggcgctcatcaataagaagaacgataactttcatatttggtcttgttgctgtgatgcttctcgcaatctgctttaataacgtagtctttcctgtctttggctgagaaacgatcattcctcgctgtccctttccgatcggagaaaggagatcaaccatacgcatggaaagcggtgcattttccgtttcaagacttattctctcattcggaaaaatcggtgttaaatcttcaaagttctttctttttgctgcgtcaaatggtttatatccattgacagactgtacatataataaggcactatacttttcattttgtgttttaatacggatatttcctactaaaatatcaccggtctttaaattgaaacggcgaatctgtgacggagaaacatatacatcattctctcctggcaaataattctcacaacgaataaatccatagccatccggcattacttccaaaataccgtttgccatatttccactgtctaaactggataattcgcttttcttattttcttttcctgcattttcatcattcgcactatttacactatttccattttctctgtcattatggtgatatactttttcttttttctctgattcctgcggtttttgctgtgtttttcttatattatcttctgatttgctattctcttctgttttgactctcttttccgctttaggttctccttctgtttttataccattttctgatttagcgtttttctctgtttttataccattttctgatgtggtatttttttctgattttatactttcttctgcctttgtctgtatacttttattttcactcgctataatccgctctattaactgattctttttcaatgtacttaccccacggatacctttttccttcgcatatgccttcaattgaaggagtgtcatttctttaaaattcattcttacctcctaaacatttaaacattttcctgtaaagaactttataatcaaattttgatattcaaacgaccaaagattcccacttgattttcttaataacttttatattcttctaaatattttatattttttgtcgcaaaaaagctacttgttcctatgccgttctctttgtaaggccaatttatctttattatcactaaattcagcattttctctactctgataaagcatgaaagtcctctttctatgcatatatacaactatcattttaaatcaattgggaaatcaaaagattgtaactaaaaatatgatgtaaactcgaaaaaaaatctcttcttcgcatcaaattattaagacgaatcagaattgtcttttctataatagcacaaactgggaagaaaacaacctgtttttgagaaatatttgattgcagaatgcgaaaaccgatgctagaatatattttgggaaaggacggaattaattatgacaaataaagaaaaagctttagaaatgcacaaacaatggaacggtaaactttctgtagaagccaaatgtcaggtagcttccgcagaagatctcgcgattgcttatacacctggtgttgcagaaccttgtcgtgctatcgcaaaaaacccaaaagaagcctacacatacacaatcaagtcaaataccgttgccgttgtatcagacggaagcgctgtacttggtcttggtaatatcggtgcccttgctgccatgcctgttatggaaggaaaggctgccctttttaaagaattcggcggtgtgaatgcatttcctatctgtttagacacacaggatacagaagaaatcattgaaactgttgtaagaatcgcccctgcttttggcggtattaacttagaagatattgcagctccacgctgttttgaaatagaagaacgtcttgacaagatgcttgacattcctgttttccatgatgatcagcatggtacagccatcgttgttcttgcaggaattatcaacgctcttaaagttgtcggcaaacaaaaagaagattgtaaagtagttgttaacggtgccggttctgccggaatcgctatcgcaaagatgcttttatcttacggatttaaagatcttacgctctgtgaccgtcagggaatcttatgctccggcgacccatccttaaactggatgcaggagaaaatgacacagattaccaatctttctcataagactgggactcttgcagatgcgatgaaaggtgccgatatttttgttggtgtatccgctcctggcatcataagccaggatatggtccgttctatggcaaaggattctattttatttactatggcaaatccagaccctgaaatccttcctcaccttgcaaaagaagcaggggcaaaggttgttggaactggtcgttctgacttcccaaatcaggtaaataacgtgcttgtattccctggaattttcaaaggtgctttagaaggccactctacacatatcacttccgagatgaaacttgccgctgctcatgcaattgctggtcttgttcctgcagaagaattaagtgatacaaacattcttccacacgcatttgacccacagattgctgacgtagtcagtgccgctgtcaaagaatatattgattaatttttatggaacgctattatagttacagtcgctttattaaagaatattttggagaaaaactctataagatctgcatagatggcggttttacctgtccaaaccgtgatgggacactcgcaactggcggatgtatcttttgcagcgaagggggaagcggagaatttacagagaacgcttccctctctgtttccgaacagattcatcttggtaagtcacagacttccagaaaatatcagggcgaacattacattgcttactttcaggcatttaccaatacttatgcccctgtagacaggcttcgcgccctctacgaggaggcgatcactgccccagaaatcgttgctttatccattggcacaagacccgactgtattactccggaaattttagatttattagaagaattaaataaaagaaaacctgtctttatcgaaatgggattacagacctctcacgacagtacggcatcctttttaaaccgggcatatccgactgaaacatttacgaaaacctgtcatgccctcgcagaggcaggtatccgcgtgaccgcacacattattctcggtcttcccggtgaaactttagacatggaactcgacacaatccgttacctaaatacactcccagtaagcggcatcaaaatttccatgctttatgtactgaaaaacaccgtacttgccagttactacgaacagcacccatttcatattcttaccatggaagaatatatcaaccatctcatcatctgtcttagccagcttcgcaaagacattgtcattgagcgaatgactggagatggcccgaaagaccttttaattgttccaaaatggatcggacacaaacgacccgtcttaaacaccatccataaagaaatgaagcaacgaaactttacgcagggaggaagcttatgtcagaagaatctttaacattatataaattaatgatactgtttatgctggataatctggattttccactgacaaattcccagctaagcgaattttttgtaaaccacggatatacatcctatttccacttacagcaggcaatcaatgaactggtggaatcagaatttgtccgtgccgaaacaatccgcaacactaccaactaccaccttatttcctcaggaaaagaagcactctccatgttccacactcagatttccgagccaattaagaacgatattctcgactactttgccgagaaaaaataccagcttcgaaaagaagtcgatattaccgcagactactatccactcaaaaagaaacgtggtgaatatatggtaaaaacccagattaaggaaaaaggctctcttcttttagaactgaacatcaacgtcgtgtcaaaagaacaggcgattgcaatctgcgacagctgggagaagaaaagtgatgcagtatatgggaaattgatggaaatgttgttgttggatgaatgagtttttgcgttttaacagatgaaaaatagaatccaggaagctaaataaagcatatttgtggcctcggagcaaggtttggatgcaagcgtataagcgaacattcaaaccgccgcgactaaagtcacaaatatgctttatttatcttcaggagttcgtctgctccgcagacgcacaaatcaggattaatctactaatttatctaattctttgacgtactctgtttcagtagccaccttatgattagcctttgtagcataaatctttacagctccctgagactttttaattggctgcattgttccagctccggctacacagccgcctggacatgccataccttctaataagtaaccgttatatttgcccttagatgctaacatcataagcttgcggcattcttctaagccttctgcattggctattttaatctctttatctggatattctttcttgattacatctactacagcctgtgctactccgccagatacggcaaagtttcttccgtctgtagatacatcattgacaccatctgcatcttcatgcatattttcaagatctaagtcttttgctgcgaagattccgctcatttcctcgaaagtaagtacaaagtctacttcgcttcgaacagttcttctcatcgcttcaagcttcttcgctgcacaaggtccgataaatacgactttggcatctggtgtatgatttttaatcaatcttgctgttaatgtcattggtgttaatgccatggatacacagtttgcatactctgggaagagcttcttcgccattactgaccatgcaggacaacaggatgttgccatgaatggaagttcttctggtacttcttttaagaaatcttctgcttcctgttttgcacataagtctgctccgattgctacttcaagtacatcggcaaatcctagttctttcatggccgcacgaagtttttctggtgttacctttggtccgaactgtcctacgaatgcaggtgctactgctgcgtataccttttcaccggactggattgccttgattacctgataaatctgagacttatctgaaattgcaccgaatggacagtttacaagacacattccacaggatacacatttatcataatcaattgttgcttttccgttctcgtcagatgtgatggctttcataccacaggcttttgcacaaggacgttcctgaacaataatcgcattataggaacatactgttgcacatcgtccacatttgatacaggcatcctgatcaataatggacttaccagttacacggtcaagagagattgccttctttggacatacttccatacaaggatgtgccagacatccctgacatccatctgttacatgtactttcttttcatcacatgcattacatgcgaacttgattacattaatgagtggtggagtgtagtaaccttctggcttatctgcttccataattccatcagatactggtgctggttctgctgctcctctatatggcaggcccattgccattcgaagccgctctcctacgattgccctttcaaggaaaacatcatttctgaagttaccagtctctcctggaatgattttgtaaggcagtgcctcaatctttttatcaacaggtccctcttcgtaagccatcttggctacttcagtaaatacagcatgtctgatttcctgaattcttgtttctactcctctcatagatacctccctatttggttaaagttgtaattgcccttaatgtgttaattatatcacaaggaaatgcatatgagaatatatgtatccaattttgtacaacttttttgttatgttcttcattttatccaaaaatctcccctctttcaaccacaaaaaaagaaagatatcgttccagttttaacacaaactgcaaaaatatctctcttttcaaaatatttgttattcttttatctattctgcaaaatctaccacaacttaaaagcagaaatagtttttagctttattccatctcgctaagaaatttttctactgttacaagctttgtacatgttacaaataaatctgttgcaacctttaattcttctattggtggtaatgttggtgcgattcgaatattagaatcttccgggtcatttccataaggataagctgcacctgctccagtaagtacaagacctgcctctttacatttagctacgattgctttcgcacatcccttttctgcgttaaaggaaatgaaatatcctccaactggtttactccaggatgcgattcctaactcgccaagttctttttctaatgtctctaatactgcctcaaactttggacggatgattgctgcatgttttttcatgtagtctttcattccattaatgtctttaaaatatctcacatgacgaagctgattaatcttatctggtccgattgtctgccatttgagtttagacttgatatctgcgatgtttgcttcagatgaagccattgctgccacacctgcacctgggaaggtaatctttgaagtggagcagaattcatagacgatatctggattaccagccttctcgcactcttctaaaatatttaaaatatgtggctgttcactttctggtctgtcataaagataatggataccatatgcattatcccagaaaatacggaaatcctttgctgctggttttaagtttgcaaatctctttactgtctcatctgagtaaacaactccacctggattggagaacattggtacacaccagattccctttacagcagggtcattattcacataatcttctacgacatccatatctggaccatcttctgtcattggcacgttaatcatctcaataccaaactgctctgtcacaccaaaatgtctgtcatagcctggcactggacataagaactttactttgtcaagtttagaccacggagtatttcccatgattccgaaaatttctgctcttgctacacagtcatacataatgttaaggctggagtttccaagtacaatcatctgggaaggctttgcacctaccatacctgccatgagttcttttgcttctggaatcccatctaacacaccataatttcttacatctgtgccattctcacttgcaagaacagactctgcatttaaaacatccatcataggcatagataaatcaagctgttcttttcctggtttacctcttgaaatatccagattcaggctcttttctttctccgcatcgtattctgcctgtaattctgcctgtaatgccagtaattcttctttgcttaattctctgtatggtttcacttcgttacctcccaaaattcctctaacgtaatttctaatctaattctaaaacaaaagaaaattaacttttccttcgtttttctttacttatttcatataccagtggtaattgtattccatttttgaataaaaagcaagccactttttcattttttccaaaaaaatcaagaaaaatgttttttaactctattttttatgaaatattcacatctcaatcctgctattctattgtttttctctggaaatttcctacattttcctgattcgcagaatttttttaccagaaaagaaacattctcttgataatgcatactataaactgtaatcaaaaaacgggggtatttcccatgagtgatttagctgctacaaactgccagaattcctgttcttccggttgcggatgtggaaatgactttggttttaataactgcttttggctgatcttaattcttttatgctgcaataatggcaatgactgcggatgtggcaatgataatctgatctggctcatccttattctctgctgctgtggcaacggctgcggtatcggcacaaacggaaatggctgtggatgcggctgctagttagccctgtattttctaatcgtaaaaaaaggactgtcacatacggcagtccttttttggctgataaaatcccattaaaatttgtcatataatctgtaaaacacaaatttaacagacatcttattcgtatttttacttgtattactattttatctatttctcctttgcattttttgctttttagtgttttctgtttccactttttcgcccgtttctccctgacactttctttttttcttaagacattccgggtctatctcataaatcgtattgtcttccacaatgagattttcattcataatcctttttctcctctcataagatggaataattacagatacttctacctgtatattacaatatatgaaaacttcacaggtagctttcctgttttaaggaggtttctatgccaaatcgaaatgattcttcatcccctctctcccgtctcataaatgatgacaatcttaccattttagaaaatgtcattccctattgtaatacaaatcttggaaaacttctggctctctgtttaaagttttctgaaatgcaaaagattatagaaggctttgatgacagtgaacgcctgaacgcctgtggcttcgaaaataattctacggatatagaatctatccttcgctccgttcgaagttctgtctctgaagaaaaagcccgccagattgataatattctacaaatcctgaatttttccagattctacgaaaaatataaccagatactttctgaacatcccgaactcgtccgtccacctgcaccagcggctgctgaaactcaaaatgctcctgaagcaaatccattttctgatccctcattattttttctcttaaattctcttatgaataattcggatggaaatcaaaatgagaaattgaaacaggtcatggcgctggcacaaaatagcgacaataaggatatggagaaaattctgtctacattgttaaattctggtttgtgaggctgtggagcagacgaactcctgaagctaaataaagcatatttgtgactttagtcgcggcggtttgaatgttcgcttaaagcgctcacatccaaaccttgctccgaggccacaaatatgctttatttagcttcaggagttctgcttgttggcagctcagaaaatcagttggagggatttggggaagagtacttactgagagctgtgctttggtagagagaaaaatagaatttattgttggagaattttaggattcgccagcggggtttctttggcgtttggatgaaagtcagaattttgtgggaaggaatttgaaaaagatgacaagagagatagaacatctgggaaatttagaaaattaagcaaaaatcctcggtaattcaattgccggttacttcactcgcataggattgcagtttaaactactgccaatgcacagccttcgaagaaagcttattccctatatttgtggcctgggagcaagtgttggatacgagcgagtagagcgagtattcaacatgccgcgactaaagtcacaaatatagggaataagctttcttcgaaggcgtctactttgcttcgcaaatcagaagttccgaaatcagtgaagcattcgcttctatatgatggaacatttttgttttttctctggatttcattttctcgactttttttccaagatattcatcaagacctaagttaaattggtttcttcgtcttttgaaaagtccccttcgtccctgttctttttcttctggttcacttaagatacgaccgcttccaagatattttccctcgccggtataaagatacacagtacttccaatgggaagttcaccctcaacgagggagccttgtatgataagactgttttgttctgcattttcttctaacgtagcgtcgtaatagaataaaaacgcagacttttcatggagttccattacctttttcttccagggttcgagattttcttcctctttatactgttccattgtccgttcgtgaaagtcttttaacttttttaacagcatcgttgtgtgtcctccacaatatcttttaatttctggcatgcttcacaataaatattatctaccattctaaggcatagttttactccctcttcttttagtttttgaagtctgttaagagcaatctggaataattgatcatttttaatacgcccatccattaatatatacagacaaagctgctgcttatgattctctccattttttaagaggagttcttcttttttctctttcatcagatctgtccctataattaacgcctcacctgaagaatattcccggatggtctgtggaaactggcatcgaaaacctgtgcggtaattttgaaatgttttcacctgaactgcaccatttccaaaaacaaatgcctgctggcaattataaccagaaagtgtattttccagttctaattcatcctgaagcagatagagcatcttacttatctttttggagttatccagttctgtccgcaaaataataaacaaatcaaactgttctgcgcttgtttccccgctcttccttgcctgcagttcttctgccttttttgttttattctgctctgacttttcatctaagctttcttttgtcattctggcgaattcttcttccatctgaatagattcttctaacaaattctgcaatttttcatagctgcatatctctctgttttcaaaaatctgtttccattcttctgaaagaatattgtagaatagctctgaataatctgcttctgtttttaggggaggaattttaacattccccttcgcactggctacaaggattttataaatcaaacgattgtctgcaatctgctgcatcttctcatcaaataaagtagcatccccaaaaattctctcatcttctggataccattcataatcctgctcaaaggtaagaagctgaaacttttcaggatgtaaaaggacaacaccatattggctgttatccatgtctacatagaactcctgcagttcgataagccccgggtaaatatgcttttgtgaaagctttttaagaatatggagtacctgtaatgcaatttttttgagaattaatgaatcaacatgaaaatgatccatctgctttctcgcaaataaagactttacaggaatcgctgaggatggcagcattccaatctgttcttcaaaaataatttcgggaatactttttaactcccggattaccggatgccctttttcaaataattcttccttacttccattccccatcgggactgtttccatacgttctctctcttccacacatttcaccctttctatgcaccaatagacacacctttcatcaaatcctttaatggcttgactatattgtctaaaaattctgtactcatcggtttcaataatttgtcaattttaatgaacatcggagaagcctcctcatcaagctccccatccggctttacaaaacaaaaatggaaatcttcctcactcatttcatctgttgagaaaaagatcacctgtcctaccggatactgtgtgtattcctcatagtcattacttccatacgcatccgtaaataccataatcgccttatttcttcccgaaacaggaaacttgcgcagggaagttccgattgctttatgcaccgattcttttccatcgtccccgccgccatacagcttggttccttttaacttttttaaaaataaggaaatatctgaagtaaaactatctcgtccctcaaataaaaccgtttctgtctcctcaccattttcttcatttcttatcagtgtgagtccaatctgcggatatacttcatattttgacaggcactctaaaaaatgtgcagctgcataatatactgctggaaatacggtatacatagatgccgtcgcatccactacaaaatctaaatacagtgtaaatgcctgttctttttctttcttaaaattctgttgtaagtctaaaggaatttctggattccaactttcattcatattgcctaacactcctgtccttttggttttatttctttctcaaaaatcaccgtttaatctgcaaaatttcaatatttgttcccgcataagtaaagatgtctccctcgcagacttctttctctttttgtttcctgataatgtggcaatcttcatgtaagataagtgcttttaccttatcatccatccgataaaatgataaaatatgtccgctcattcttccattctggcttcgttcctgctttgtaccaaattcaatcggaataaaacgataattcttcatatatggactatattttacatcaccgatacggtaggaaaaacgaatcgttttctgctcctgtggctgttctaaaaattcgggaagttcaggaagctttctaacagacataaggtattctttcatatcctgaatcacttcttttatacttccatatcgttcttcttctctcgctatcatctttgcaataatacggcttaaacgatcatcaattcctggcatctcttttaactgataggcgtagtcatcccctatcatgtaattctttatctcatcatttccatagaaatgatgcttccctgtataaataaaataaagtacaagtccggcagaataaatatccatctccggccggcagatataactgttccaatatcttggatcggcatatcctggcgttcctttctgttctctccgaagcatgacagtcacatttgatgcatgaagatgtacccagtcaaaatcaataatcttaacaacagaaccatccggggaggccagtacattctccggctttaaatctcgatgaacaatcggatcctgccggtacatagacatataatgatctattccaagcaggaacttcattgcaatgcgattcctcaccttcattttctcattccaggtatctcctgcaatccctcggccgcgcatcagttctgatagatcactttcttcgatatattctaccaatgtaataaaacgcttgtttttctcgtcaagcattcctccataaattcggataatataaggagaatacaactgtaccttactttctttttctacataaacctgctcaagatcattacaaaacaacaccttcacaaaatactttttacctgtgcggatgtcttcggcaatcatggcctgcttacttccggtgcggtgacattcttttaacatttttaaagatacgaccatattttctccggaccgttctctgtcgcgaatccatgtgaaaacttcgccctcttcaaaataacaattcatcttaccggcctcctataaaacggtttttaaaaagtttctcttttaatgacagcggcttcttgctcttaggaagttctgtataacagcagatatcttccttttttttcgactgtctggtatctgttttgggaaactttacttcgctttcctttttgtttttttccttttcctgatttacataaagaattgctgtctgattatcctcttccccgctttctcttgcgctctcaaaaatctgtccaatcactctttgcgggcgctcacaatcacaacatatcgtttcgatttctgcttttgtaagatctccgaacgctccgtctgagcccatcagtattccgtcaatctcctctgcgggaaacagacggcaatagggcttacattcctttctctttccaagataatcaagcaggcgattcttattctgataatataatacggaccctgctgttgtttttccttcccttaccatctcttccgccacattctgtacttcactgataagctcaattgttccattcttgatgcggtatattggactgtccccgcaatttgatacaataaatgtatcccagaaatgaatcaccgcagacaaggtggttcctcctttgattccggcatccaatcctttcttatacaatccctgatttaacttactatatatttcttcagaaaattcctgtaaaatctcaatctgccggtctaagggattccctttaaatcgatcactcatcaatgtctgcagcaattcctgataccacagatttactgccgcctctgaataatatttacccccggaaagtccgcccattccatctgctactaccatcgcttttactactgcttctgcattcatatgaatctccatctggcaatagctgtcttcattcgatgagcgccggtttatttcacttgcaaaaaagaaagccaccgtacttcctcccttccctcatttgaaaatttctttcctttatgatacactgattcacataaaaaatctacaaaaggaggttctccatgtttccgaaatcgttttccgattttacattctatcagaaaaaaaaagatattttaatctataaagctgctgattctaatcatcagtatattttaaagtgcagcgagaatactacccctgcgctaaaacaggcactccttgatgaatatgagggattatcccctctgtcccatccatctctcccaaagtattatgggttctgcgagaatttctcattaccagaatcaaatactcctgtctttgcgctttgtatggagtgctgtgatggctgcttattgcctaaactcgtaccatttttggctttagaagatctattatatctcctgctttctactggaaaagtgctttcttatcttctcgagaaaggaattctttatacggatcttcatccgtccaatgtacttataagaacattagacgggcatctggcaatcactttattagactttacttactgttactacttcctgaataatccaaatccaccatatgagctgcgtttttcttataatctttctcctgacttaaagggacagcagatgttgattcaggaacttacttactttctccacgctcttcttgaaataaaagagcaacagcgcacaggtaaaaaagaaccccttcctttttctgtgtgcatgcttcttgaaacgggaaatcatccaccagagaatctctcccttcaagaattcttaattatgattcaaaaatgcttccttagtttctagagcgtgtttgaaaaatgctttctgcaagatgtgcgttacaatttgtgggagattttacctgaatgagggcggcgtagcgggctacgtcaactgaatgaaggcaaaatataccgcaaattggggcgtgcagattgtaggaatggtttttcaaacacgctctagagcttgtttgagaaatcctctaatttgcatcaaaaagtgtattgtataaatcttctaccactggtgcaagtgtttttccaatttccgttgtctttaaacgatttgcaacgatgacatactgcggattatctgccggtgcaaatgtaacaagccatgcgttgttcgttccatctccccgctccgcagttcctgtcttcgcagcaatagaatattctttctctcctactgtggacattccataagactgtgctgcagccttcattgcttctttaatctcctgcgcagtatccgtatccattgtctctactaacttttctgacttgccttccgctgttgtctgcccttttccattgactacagatttaaaaagatatggctttaacattacaccatcatttgcaatactctgtgtaaccatcgccatctgaaggggtgtaacaagagtttctccctggccaaatgctgttgtcgcaacaacattatcttcataaccctttaaatcaaagttagaatggattgttgcaaaatcaagagaaatgtcttccccaagtaaaaagctttttcctgtcttataaaggcgaaggccgccaagctttaacgcccggttcataaagtacacattagaggatttcacaaacccttcccggaatgaaatacttccataggctttaccaccataatttcgtattgtctgtccatttaccgtaattgaaccagtgtcttcaacttcttctcgttcaatacctgcttctacgatttctttggatgtgattaatttaaatacggaacctggcgctaccggattctggtatgcattggagaggaatactccttctttttcattgatttttttccacttatcttcaatctcagacacattaaaagatggcgaagatgctaacgctaatatttctcctgtctttgcatcaagaactgcaacagatcctttatatttctcaatgtccttatatgctctttcctgcaaagccgcatcaatcgtaagagaaacatccgcacctttcttttgctttggattagccccgcaattgctgtgaacaagttcttcattcatcgtcttttctacaccgtatgttccataaatcttggaccagtaaccaacgagattagaaaaagcatagggatgagagtatgtgcgtgctccgcccggcttttgtgaaaatgcaatcgtatttccattacggtctaaaatagatcctctcacatattctttctcatatatctttgccttggcctgactcttctttttgtccgcttcttttgatacgcccggaagcagcgcggaaactctcacgagagaaatgatcattaagatgacgcagataagcgtggcactttgcagtaactgcgttctccttaaaaaatttatcctgttcttcttcatcttctactgttcctttccatttgacattacttgacaccgctacgataagtcccacgatcataaagctgatcataagtgaagttcctccgcttgaaataaatggcagcgtgattccggtaagtgggcacagcccggtacttccagcgatgataattaatgtctggtcaaaaagcataaatacaaatcccgcgccaactgctctgtgatagcggtcctgttttcttacaaaaagtcttactccctcaagccacatcataataaatacaataaatacaagcagtgcaaatatcataccacaacgctgaatcagtgctggataaacgaggtcactcgtcttaaccggcagctctgtcacagaagaggttccaaaccaccctccaagtacgatagactctttcgctttaagaagctgatatccaagtcctaaagcatccttttccggatgcagccaataaataaaacgattcgctatcttgttataatttgaaaggaaaatctgtgccagtttgttcgttccaagaaacactcctgcactattccactttgtaatctgtgctcctataacagaaagtccgacagaacctgctgccatgacgaacaccgttccgataaatacctttatatctggaacgaataaaaagaggaatgttaaaaacagcataagaatcagaagcatggttccaaattcactctgtaatgccaaaaacaatacttctaaaaatgttacagtataaaaagcccgtatattctccttatccggattcgcctttgttcctaaaagtcctgccgcaataaatacatatagaaacttaataaactctgttgtctgtaaagaaacaccacctattgtaatccagtttcttacgttaccaacactctttgcaagaacaagagttgctgccgacagcaataaggaaaaccaaaagaatattctgcataccttaatcgtcgataatttaaaacgcttcaaacactttatagaagcaatatttctgctatttatataaatgaacgctgccaaaagagccatcacaaatccaagaatatactgaaactgcaatgatgttgccggattatgtgtcgcataatactgcggattctttaatacctgctcttctttaaaaatacattgcagcatcgttcctaccgtaagaagtaacaaggtataaataacaatcttcttatttccgtgtatcacagaggtaaaaaaccaggataataacgtaatcgcaagtaagattcctatcatatcaagataaatctttcctgcgcctttcgcctgcacaaagataaaggccgctgcctgcatcaacagcagggcaagaaccggactatttttaaaggaataaaatgctctctggatttcccataccaccctttcaaaagaaaaggcttttgttccagtatcatgcctactcatagcttccctccgcatttttataaagtcttgtagactggcttcttccgccctctaccgcaatctgaaattcttcatttccaatgtaaactcttaaaccatctgacaatggaacctgccctgtcaccattccattcacataaagcttattcatcgttcccacatcttctaatagataacgtccgtctctctcaataatgcggcaatgattccttgctacacataaatcatccagtactaaatcattacttgtacttcttccaattgtaaatggaatcttattcacgcggtaccgcgccataactctgtgattggcatccagcttcataagcgtaattcccgttgtttctctcttcttcatcggaacaatcttgccactttcgtctttataatcctgccctacgctgctttcttccggctgcattctctcctggcgctttcgttcctgctcttcatagtcatataaccaatctgtgttaactcgaatactctctccatcatatccgtcctgctgagattcttcttcatattccatctctgagaaatcattcttctttggatattcttcggcatactgttcttcctctaatgcctgtttttcttctttttcttcacgtaactcatactcttcaggttcgttatcctcatcaaccagaattccttttcgtttctgtttcttttgtaactttttctgttctttttctttttgaacttctaacttcttttcctcacgtttttgcttaatttcctccttcttttcctgtcttaatgcccactcatctacgaagttctctccctcctcggaagccttctttagattcttattcgaacgtattaaaacaagtacaataaatgcaattaaaataactaccccaatctgcgaaataatagacataaatatagctcctgcctttcgttatttttaaaaacgctgctgcgttcttaccaatcactttcaacaggagcataccataaatagtgcctttattcaaatattagctttctgaacttttactgattctttcttacttttgctactgcttctaccatagaagacaagtcgcttttccatccatcctcttcttctccaagaacttccgccaggatagaaagaagggcttttccatccagattattttttataaattctttctggatttcttccacattctgcatgccattctctttctggtaacatttacctgtccagattgaatataaagttgccgcataaaagtacatgtcattacgaaggaaatccttcgtaaagcggctaggccgtctcacataacaatagtcctcaaacttttccatatcaagagcatccggtacatagttcttttcaatcaaaagagctggaatttcctgaaactcaacttcctgccagttatcaattccctcttccatatattctgccgcactcttcttaaaagaaacatttttcttattgcggttcatatcatcaaaaagcagtttatcttccattgcaaaacggcagtagccgttcttctcatacccaaattctctattcttttcattttttaagatttgtctgccgatacagaaggaaaaccaccatttctgtgcagctggaagttcataaacagaattatatttccggcataaatcttcctcgatttcatagcctttctggcgcagtctctctgatgcagattcaatcataatccagatttcctggctgttagccactgaattcgacttgtatctggcaatcatttcgataatgacttctgccggtgtaatgccaagaggttccatctgtgcctttgcaagtaatttctcaatggattcatacgttggctgcaaggcaatacagaaccgcagcagccattctcttgtaacaactgctttgcctgctcttatctttgaaaactgtgcttcacagtgaagacagccaatatctcttaaaaaccaggcagccttatcatagtatccatattcttcctcaataacttcttcaagacactggccaaacttccttgttccatccttaaactcatctttgtaacttcgaatgagttcatagaattcctctaatgtcttcacttcagaaagcataacccacaaatccatcgttgcaaggcttctgctgtcctgctgtatattttcttctaaaatgtcttcaatatgtgcccggacatcttcaaaggcatcaattggaaaaagtccattaatcagtgcaatccacaaagcatcatcaatattcttacagtaaagtccatatcccatataggtttccagaaggatgtggttaatttcctctaaattcatttcaaatgccataccaagtgtgacatagatatccctggatgatggcatggaaccacgaagccatgccccgattgcctgtcttgtcacaggtacataagaaactgttccctctttcttcttttctacacggtgaaacaccttttttgccaaagatgtattgctgtaatcaaaggcatccattttttcctctaaaaatctggaaaatggaattttatttttctgcccttctgccagccgttcttctatcgcattcataaaagattctatcgtatcgtctgctaatctttccataacttcctctttttctatctgcctgcatgtgccgattcttcttccatctgacttttttcctttttcaggcgaaggagattcactacctgaatacataccgtaattactcccaaaataataaaatagtacagtctcactttttgcgaacggaaaaaccaggccgccgcttcaataatccagccttctaccagacacaggccaactaccttccacagaggataactcgcctttctctgaataatcacagcctgataatttagcatgagaagaacccacatgcccgccataccaagtgcaatcttccaatggccaatcattaaagaataatgagataagtacatgatacaaccggtgagaaatccttgcgggaatcccataagtaaaaatggaactgccggtccttcctcttctaagctgtcctctactgcctctgcctccacattctctatctccgtgcctgtttttctcgctttttctttctctgtttctgctgctttcttataccgtcgtcccatgtcactgtcctcctcaccactgtctttcgattgtccgcctttttttattctatgtgttctgtgtccgcgttcctgacgaagcaccattcttgtttccggccggtatccgccgagcattttctccacataacacgctgtatctaactgctttttattaaagagcgctgcatgttcctgtagctgctttacaaaatcctgaagaatcttaatccactgctcccttcggttcaaatgaatcgctattttatcgaacagttcaaaccggtctttgtcaaaaagttcctcattcaaaaggccgattcctgtacgaaggatctcatctttttgttctcctggtactttctcctcattaaaatctttcacatacttatacagactttccatgtccctcgcattcatgcgaaacagactttttccataatcagatagcttctgattcgccaaagtttcacatagaaggctggtataaatatccttatttttctctctgatcacagcaagaagtgaggcaaactctactttatcttcctcaaatacctcccctaacactctgtcgatttcttttaaaatccgctctcttgagcgtcctgtcatgccagttaaaagattctctatatatttctgtctttcttttgctgaaaacttatattccctgatttcttttaaaatatcttctgctacatattctaatgctttgtctttacatacccaatataatagttctggaaaattttcacttaaaatttctatgctaagtgcactctgtccatgctttcttgcaatatcatagaaaatccactctactttcttaagaagatttccgttatctcgaacagtctttaaatacttcccagccgttttttgaaaatctcgatagatctcgtcttctttttggcttgcctgtgcaaatccattataaaaatactgatcaagggctgtctgcgtgttctcccaatcatttctttcagatttttcagaaaggttaaaatactttgttccacatactttctgtgaaaaatagaaagaaacggatgggattgcctctcttgtaaaggaaacatatcctgctctttcccttgccggctgcggcagcaagctgtgaattacatacatcaaacgctttgctttttctgcaaattcttcttctttccaatccggtgccacaatattaattccctcagagtgtcccgacaaacaccaaaagactacctgcataaattcaggcagtcttgacataagattcatctcctgcaagatatcttttctatgaaattccggttcttcaaggaataacggctgtaaataaccaacactctcttcctctgcccattcccctcccggtgcaagataggctactggattactttcaggagccttgggctgataaattctaactctcttattctgccgcttatcctctcccgattcacatggaacagaactcatctttacaaaaccacaaacagaactataaacaagttcatctacttctgtttttccagtcttatctataacagctgcctgtgccagcttttcaagttctcttaaataggctctgtcttccggcatggaggaagcagtaattccccagccaagtttattcccggaaatgcaatgattcgaccacatatactcatgtattaaatattctgtcttcattcaagccaccctctttcctgcatgaacttcatcatcatccacagtattggttcctctgttcgaatcggccgtactcttcctactgttttcacttccttttgtgttccctccatcgtctcctctgtctcacagccaagtgctgatactgcaaagagaccactctctttgtaatctgcaagattacgctgcagacggaacactttctgatcaaaaatctgttttaatatctcctgtcttaaaaaatgatgatccatattcataaagccataagatacctgctttctctcaaataaaagactgcttcccctgtattcctttatctctccaagttcctctaataaatcactctttgcgatagtaagagccatatacttctgctttaattcatgatctccaagaacagaacgaatagaatctaaaacggtgtctgcctttctctcataaaaatactcgtcactcatcgtattctccatcatgaaatccgcctgatccataacctgctttccattctcattactcattctctgaatggacatctgttcttccttccccatgacataaagtttctctaatactcgctcctcatcaggaatctgtttattaatgagagaatgttccagatgcatctgcgctggatctaccaggcagataaatccatccatatgccggacaaatcctgttcttcctgtacctgcactgtctctgataagctctcccgccacatcataaattgccgtaagcatatgcagattcttctgtccaatccgataggtcacttccaaaaataccggttttttaaaagccttacttgttgactccggacagattccataccgcataagacggtcggcattccgctccatctctatcttataatcatcatttggattgccataagcattacgaaccgtaagattctgtctctgcatcacatcaaatccattcatcattagagaacaaagatacacggtcttaccagaagcgacacttcctgcaagcccgatcatcaacatctcatatttaaaaaagttctgtggaagtacattatgacagtgcggacagaccatcgtattggaaaaaagggtaaccgctccctcttccacatgaaacgtatatccacaactatccgtatcaaagcgtttcacggcaagatctcttccggccgctgtcagttcctgattcagttctgtcataacttcattatctataataattctctttgcatcgatttgttcttccgggattcccatagcgctccagaaatacaaatacgccgtatctgtcttataagaaaatacttcatttaacgctggtgactgaaatcttaccccgtctgttcttaaaagaaatcctgcatcctcatttgaaatattacggaaacagtaaggacatttcttcacccgtattgtttttgtctcctgcatctgtatctctcccgtctaacatcttttcgttgctttaatcgaaatctcgtgttttgattccaaaataatataatacttgacatcctgctttatgaccgcctgctttgtcggaacaccctgtcctcgcgaaagacctgcctcgcgaatctcaaatggctgctgtttcgaaataaccgtcagttcttctggattatcgcaggcacagatttccaatccctgatcttcgatataataagtaaactctttacccgacggatgctttccatacataagaatattatcaagcgccaccttatccctgcggattcttccatctggacaaatcgctgcacagccaccaaaggcggaaccatgcgtaatcataaagtccatgccaaataagcggtctttctgcttcttttcttcttcctgtctctgctgccgttcttcttctctcttctgactctctaattccgaaacttgcccggcataatccaatatgtatttttcctgttgctgccgaccactctgccgcttccactgaacgactccgaccaccgccattaatgccgcaatcacaagcccggcttccattgtaaaagtagaaatcaactctttacacctcatttttattcattatatgcaaaaagaaatcttttttattctccttgcccttatacgattataacagaaaaaaagcatttctcaaagagggtgatttattggtttttactagagtgtgtttgaaaaatgattttttaaacacactctagatttccacaaaaaaatattataaaataataaatatatgtaacgaccttactttacgcaaatatcctaattcattctgcgtagttatataacatatatttctgaataattatcataaatactattttgaataatcagcatataacactatagaaataacatagaaatgaggactttactatggctcttgaatcattacatctgaaaaaagaatttgaaatacggcagcttacttctctccactattttgaatataaaagtgactttatttttaaaagtgagtatcacgattactggaaacttctctatgtggaggatggctctgccgaaatctctttttccaacaaaaaacaggcacctgtcactttgcaaaagggtgaacttttcatccagtctccaaatgaatactactcttttagggcctcctccggcaatattgccgttctatttaccgcaggtttttacagtgataccgcaaatctttcattgctcgccaacaaaaagcttgtatgccagaaaaaagagaccgagttattacaggcactcgccttagaaggaaaaaacaacttttctccaaaaatcaacccagcatcgcctgctgccctcgaacgaagatataaccagcctttcggcggtgaacaacttatcggcatttaccttgaaatgctcctcatcagcctaatgcgccagtatacttcttccgaagagaaaaaagaaactccatctgaaaatacaaaaaaagacgcttccgcttctctcttaaaaacagattctattcttttcaaccgaatcaccgattattatgaggcacatatcaccgaacatattaaggtagaacatctttgcaaagaatttggcataggccgctcccatctacagagaatttttcgtgaacagactggctatggagcaatcgaatacttttgccagatgcgaatcagtgccgccaaacggtgcattcgggagaatcgtatgaatctgacagataccgctgcctcgctgggctatacctcaatctattacttttcaaaacagtttaaaaaaatcacgggaatgtctccatcacagtatcagaagatggtgcgaagttctaagaaagaccctctttatgaacagagagagctttgattttctttgcaaaatagacgaacccggaaaatgaaaaaagatatatttgtgactttagtcgctgcaggttgaatgttcgctcatgcgctcgcatccaacctttgctccgaggccacaaatatatcttttttcattttccgggttctgattgtggttgctgaagtaaattcaacagctgtctctatcaaaatattcgaggagttttatagaacttcgcatttagacgatttgttgactctccagacacttttgattttactactgtggcgtctcccctgcctgcgtcaatcagagtcctaactccacagttcctccggatacactccttgttgtttcatctcagaaattgcatccattactgattttttatcttctttataagttacgccataccatttttcagcggattccatcacctctacagttgcgcgtttttctttgagcagttcttctactacgcttggaaggaagtattcgcatttcatagggttttcttttaatcctttgtctaaaaatgcagggaatttgtcctcaagtacttttaaaaatcctggtgtgaatccccagcagttcatggaaactggtgttttgtctggaactggtgtccaggttgctccgtcatcaagagtaaaggcagcttctgctcctcgtttttcaatccttgttctttctgtgatttcttttaagtagtggtttttgtctacctgacatacgcctcgggatacatgaccattttctgtgatagttttttcgatatgaaatgcaatcataacatagcggtataaatcatcatcttcatgtgttgtcagataatcatagagcatctgaaatgcttttggcccataataatcatcggcattgattacggcaaatggggcatctaccacgtctttacagcatagaagggcatgacctgttccaaatggtttttctcttccttctggcacctgataaccctctggcagcttatccagctcctgaaaaacatattctacttccataaatggctcgattcgttttccaacgatttccctaaagtctttttcaatggcatgttttataataaacactacctttttaaagccagctctttttgcatcataaacactaaaatctaaaatcgcatgtccctgttcatctactggatccatctgctttaatccaccatagcggcttcccattccggcagccattacaattaatactggttctttcattctttcttcctcctaaaatatatcatgccctctcggagtctttttgttcctgcttttgtgaaaagattttttatcagttatgtctaaattttcgaagtgtatacagtttatactttgatgaaattcaggtacatctgacaaaaaaacggctgcaaaagcacatgtaagaaaggctctgaatagtacatctaaattataaaaaaatttaagctaactttttcattttcccataaaaaaagtcaaacttcaatcagaatttatattatttttataattattatggatttatcccaaatgtttatatttctttcgttgagaacggtaaaaaaagacaatataatataattatcgacatttgatattttcatcacaagcaatcattatgcaaaacgaaaagtcgtaaatcaaaaaaggaggcagttatgacgcaaacaaggtatactttacagcagcatcatgttaacctaaagtcatctgtaaaattgtcgcatgtcaatatgtatcattgcgaatcccctgcttcaaacatctttccggggcatccgtattcaaaaattatctttattcaaaagggacagggacaattttatttcggcaatcaatttttaccggttcgagaaaatgatttattactggtgaatcctgataagcagaaattttctgttgacgttcgggaatcccctctcgattttgtgatactggggattgagaatctatctttcattgatgacaccaaacagtgcatccctccatttaccagattatcatttccttctgatacctgtcagcatttaatgcatatgctgattcatgagttagaaaagcattctgagttttatgaagatgcatgtcggtattacctgaatcttattcttatcgaaattcagcgaaataccaacattcattatgattttccttctaaagaaaaaaataatcgggactgcaagtttgtcaaagaatatttggacagccattacacagaaaatatcactcttgatattctctcaaaagaaagtaagatgaacaaatattatcttgttcattcttttacaaagcactttggctgttccccaatcagttatctcaatgacaaacgaattgaagaaagtaagaacctacttgaaacaaccaatcattctattgcagccattgcttctatgattggtttttcctcgcaatcttacttctcacaatcttttaagaaaaatacttttatgactccgaatgaataccggagggcttcacggcagatttaaaccccataatttcattgtgcatcgcataataaattgaaattattttatatattatataatccgggtatcattttctttcagcatatccggattattttatcattttctacttttattttctattttgactgcccattttacttttttcccgtcacttttggtcattattttttcgtgtttcatctggaaaaagcgtttaagttatagtataatgatataattaatgtaaaaacagtatctaatataggaggattttatccatgccagtaaaatacgtattcgtcacaggtggagttgtttccggtttaggaaagggtattactgctgcttcccttggacgtcttttaaaagctcgtggttataaagtaaccagccagaaatttgatccatatatcaatatggacccaggtacaatgaacccaattcagcacggtgaagttttcgttacggatgatggtgctgagacagaccttgatcttggacattatgaacgtttcattgatgagaagttaaataagcagtccaatgttactaccggtaaagtatactggagcattcttaacaaagaacgccgcggagatttcggtggacatactgtacaggttatcccacacgttaccaacgagatcaagagccgtttctatcacaatgaagacgcttctgagacagaagtagccatcatcgaaattggaggaacagctggcgatatcgaaagccagccattcttagaggcccttcgtcagttccagcatgaagtaggacacgagaactgtatcctcatccatgtaactttaattccttacttaaaggcttctggagaattaaagaccaagcctacacaggcaagtgtaaaagaacttcagggaatgggaattcagccagatattcttgtatgtcgttctgaccttcctttagatgatgatattaaagccaaaatcgctcagttctgtaatgttccaaagaaacgcgttatccagaacttagatgttgatattttatatgaattaccactcgctatggaaaaagaaaaacttgcaaacgtggcttgtgaatgtctcaacatggaatgcccacagccagatttaactgactggatcgacatggttaatgcatggaaacatccaaaacataaagtaaaagttgccctcgttggtaaatatgtttctctccatgatgcttatatcagtgtagtagaagcattaaaacatggcgctgttgctaacaatgcagaggttgagattaagtgggttgactctgaattagtaagtgattacaacgtagacagcttcttctctgacgtagacggaatcatcgttccaggtggattcggtgacagaggtatcgagggaatgatctgctctatccgctatgcccgtgaacacaagattccttaccttggactttgccttggtatgcagcttactatcgtagaatttgctcgtaacgttctcggattaaaagatgcacacagtcatgaatttaatgaaaacacagcgaatcctgtcattcatatcatgcctgataaagaaggcatcactgatttaggcggaacacttcgtcttggttcctatccatgtatccttgacaaacactccaaagcatatcagctttatggtcataaacagattgaagaaagacatcgtcaccgttacgaagttaataacgattaccgtgaagtacttcaggaaaatggaatgatgctttccggattctccccagatggacgtatcgtcgagatggttgaaattcctgagcatccttggtttattggaacacaggcacatcctgagtttaaatcaagaccaaataagccacatcctttatttaagggattcctggctgcttcattagcacatcagaagtaggtgattttttagggtgagaaacccgttagagatagacaattccttgtttgtggctttggtcgctgtgaggggaagtcttctataaaaaaccgcccgttaaaaatattgattttgactcagttgtaaaaatcaatatttttaacgggcggtttttttactttggttttttttccccttttgtatccccaaagacagaccccagagaaggaaagactctatatttgtggcctcggagcaaaggttggatgcgagcgcttaagcgaacattcaacctgccgtgactaaagtcacaaatatagagtctttccttctctgggggcgtctgttggtctaaagcaaaatttcatacaatatcgctattaggatacagacgccgcttcctgcgaagaatcggagatctggtttccatttttcgttgtttttgaagatattgtcgttatctttcagaatattttcgttgtttattgtagtttctgttgttttttctgttttagcaatcagaaggataagccagcctgcgattactgcacttaatattgctatgagtcctcctataatcaggaggcttatttctattttcccctgtgtgtctgtcaatgagggattaaataaggtatagcctgcgatattgcattgtaaaatggcctgtatggcattacttttctcgaagcaggttattattacggtaaatgcattaaagagcatatggagcaatatggagacgctcaaattgtcagtcaagtagataacaatggcaaataccagccccataacaaatgcatagcacatctgattaaagttcatatgcaggaatgcaaataacagcgctgagattatgattgccatctttttattacttttgttcgcaattccacggtaaatcattcctcggaaaaggaattcctcgataatcgccggcaaaatagcaactacgactaatgcttctactggtttatttacaattgcctgcaaagaatcatctaataagttctgaaatgcgatcatggaacaggcatttacatagtctgccatgataaataaaaatatcgcagcaactataataagcccaatactctttaatgaaacttttctcaaatgacagtattccactggctttacatatgcattctggcaaacccagaatacatagagcaataataattcattaagaagtatcgttccctgataacttatatcaagagaatacatcataaaaatagttatgatacagcctgcaatgcagatttcgatacgccgtatatttttctcctgtatattggccagaaaaaaccatatcgctattgctgctattattcttccaaatggaaggattgcaagcactgaatccagaacagaccccactatatgcagcaatacgattgtaaaccatattctatttggatttaaaaatttttgctgtgacattagtctattcttccgttaactcgattcctgttttgcttattttaattttcttgctcttatataaacgtccaattgcacgtttgaattcatttttactcattccaaattcgcttcggatatcttcaggcgcagatttatcgtgatatggaaggaatccgtcattctcttttaatttttctaaaatctttgcggagtcaacatccatctgtaaatatgctttttcacgaagacttaagttaagctttccatcttctcttactgaaagcactcttgcctgtactttttctccaatttttaactttctgacgatttctttattctgaagcataccattatatttattatctactgccacaaatacgccgtattctgggttctttccatataccgttccttctacaatatcatctgtcttatatggagaatctgtacgcagaaagtcatatactttcatcgtagcacaaagtctgtcactcttatcaatatagagacctactaaatatttctcgcccttttgtacctttacaacctgttcgctgtagggaagaagtaaatccttttccagtccccagtacataaatccaccgatgttatttacctgcgctacctgtaaaacggcaagctctcctaactgaagctttggcatatttgttgtcgcaatttctctgtctttagagtcacggtatacaaatacctctacctcatcaccaatctttgcgttctgtggaacctgtttcttcgggagcagtacacagtcgctctttccatttctctctggagtatcagaaagatacactccaaaatctgttttatggtcaatatataacttctgttttacgcctaattctatcatttacaatccttactgttattgatatggattattacatatctaatcagcttttcctttcttaaatttattctatattctctttgtttttctcaatgtttattctatacttatttttttaatttttattttgtttattgcttttttattttaatatctgaataccttgattttcacattttaagtcattgactcatttttatctatctttttcttttgatattcatttttgaattactgcatactctctttttcttaatcttctatagtttttaaagtcatttctaccaatgcagcaatttcaccatctggttttatatattttaccttgaaaatatcttcctgctgctgtacaaatacctgtattgtttctttaaacatggcggctttacggtaatcaatccgaacttctttcgcacaggcaccttctgggagaatatcttctgtccacaaagcatatactgtattatttacatgattattactatctaaatactgttttgtaacttcgattggttcgtattctttccactcaccatcatctgaaatctttcgattgattcttacagttttatctgcatccttctccacataaatatcagcgatttcctttgtgactttcattggaagcatcttctgtgtattcatcagaatccatattgcctccgcagaaacaattgtcgctccctgctcgtctataatagaatatcttctatatccataaaatcctcgcatcttatatgcctgcgttgtgacatcaatatattctgacattcttggatgtcttataatctttacgttccacgcaatcaaataccaggctctatggttcttctggtcttcttccacacctaatcctaactcttctgactggaaagttccacagtcctgaaaatattctaaaatctgatgcagtcttgctattccttctcggtccacctcactgtagcgaacccgtattttcatttcatacatataatgcaccttttacttttttatactatatcaggtatattcgttttcctgacaatgccgtattatcataacatattttttttattttttcatcagatttctgttttatctatctttatttatctatttattctttacgtaatcatttcttcattttttcctacttttcccatattacttttattactttctttgctttattatttaatacatttattttatctacaaaaatttttacttgattctcatcagccacttcatattcatctgtcatttactgttttaactcaactaaatccaggcactgtcagccctaaaagagagaagctatcctatatttgcagtcttagcacgaggattaaatgcgagccagagggcgaacattcaacccacagtgatagagtcacaaatatagaatagcttctttcatatcatcagcctgttaatgagttaaataataaaaactacattaaacgattcttcttctctttctcttctctgattaaagtcttcatcgctgtctccaccgctgttgtctcgccaaagaaagctaatgtagtgatatgctgtggacagcttccgttaatctctactggatatacattacttgtcttaaatgcgcggtctgcatagtataatacaccagcaaccgttgtctggagcagtcctactgcatcaaactttctgctttttaattcttccctgctctctgcattcatcttacggtaaaacatcttcattactgaagcacttggattatagataatacgtccttctgtcattttgaacctccactatgtttcgtacacattctttttagtataattattaattatcatgatagcatactcattattaagtaacaatgtactttcttgctgttagtatgtaatatcttcccaaggtacaaaaaaaggacacaataatgtgtcccttctcttacagcgctaccaggattcgaacctggaaatgctggaatcagaatccagtgccttaccatttggcgatagcgctatattaactgattctaaaagaatcaaacgtgggcaagaggattcgaacccccgaccttttggtccgtagccaaacgctctatccagctgagctatgcccacaaagttcttaagatatgccggcgatcggaatcgaaccgatacgggagtataagtcccgcaggattttaagtcctgtgcgtctgccagttccgccacgccggcataaatgggacctacaggacttgaacctgtgaccctctgcttgtaaggcagatgctctcccagctgagctaaaatcccaaatatacttattaaattttaattccttacggaaacgacccggatgggattcgaacccacgacctccgccgtgacagggcggcgctctaaccagctgagccaccgggccaaaattattcaaatagagtggaccttcagggacttgaaccccggaccgatcggttatgagccgattgctctaaccagctgagctaaaggtccctagaacaatccaaatcaaactaaatcaaaatttaatttgtgaagccgatgaacggactcgaaccgttaacctgctgattacaaatcagctgctctgccaattgagccacatcggcactctattgagtgactcctacgggatttgaacccatgttaccgccgtgaaagggcggtgtcttaaccacttgaccaaggagccagactccccgagtaggacttgaacctacgacagcgcggttaacagccgcgtgctctaccgactgagctatcgaggaatattgtcaggtgtcataccctgaaaaccacacacattatatcatatctctttgaactttgcaagtactttttaaggtcaagctttcgaccgattagtaacagtcaactccatgcatcgctgcacttccatctctgccctatctacctcatcgtctctaaggggtctctcactctttcgagtctggatatctcatcttgaggggggcttcacgcttagatgccttcagcgtttatcccttcccgtcttggctacccggccgtgccattggcatgacaaccggtccaccagcggacggtccatcccggtcctctcgtactaaggacagctcctctcagatatcctgcgcccgcgccggatagggaccgaactgtctcacgacgttctgaacccagctcgcgtaccgctttaatgggcgaacagcccaacccttggaacctgctccagctccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctactttcgtacctgctccacccgtcggtgtcgcagtcaagcctccttctgcctttgcactctctggatggtttccaaccatcctgaggagacctttgagcgcctccgataccctttcggaggcgaccgccccagtcaaactccccgcctgacattgtcccccgcccgggtcacgggcgcaggttagaaacccagtactgcaggggtggtatcccaacatcggctccctcacggctggcgccataagttcttagcctcccacctatcctgtacatgcaataccgaatcccagtatcaggctggagtaaagctccatggggtctttccgtcctggcgcgggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcaaaccttcgctcgcgctaagctctccccttaaccttccagcaccgggcaggcgtcagcccatatacctcacctttcggtttcgcatagacctgtgtttttgctaaacagttgcttgggccatttctctgcggctgcttgcgcagcactccttctcccgaagttacggagtcattttgccgagttccttaacaacacttctcccgccggccttaggatcctctcctcatccacctgtgtcggtttacggtacgggcccttgctacacgatagcggcttttctcgacaggaaggggccgcagcttcactacttcatttcgctccgcatcacgccttcgtctcatgcagggcggattttccaaccctgcgactacttcgcttgcaccgggctttccattcccggctctgcttcccttcccgtgtccccgcagttctgataacaaggggtgcaggaatcttaaacctgctgtccatcggatacgcatctctgcctctccttaggccccgacttacccagagcagatcagctttactctggaaaccttggatattcggccgcaaggattctcaccttgctctcgctactcattccggcattctctcttcttagcggtccacatccccttccggtaatgcttcgctcccctaagaatgctcctctaccaacccttacgggttccgcggcttcggtgtggtgtttcagccccggacattttcggcgcaggacctctcgaccagtgagctgttacgcactcttttaatgaatggctgcttctgagccaacatcctggttgtcttagagatcccacatccttttccacttaacacccactttgggaccttagccggcggtctgggctctttcccttttgactgtccaacttatctcgtacagtctgactcccatacaccatctgtccggcattcggagtttgatattctttggtaggctttgacgcccccgcggaaattcagtgctctacctccggcagacttgtatgaggctagccctaaagctatttcgaggagaaccagctatctccgggttcgattggaatttctccgctatccacacctcatccccacccttttcaacggatgtgggttcggtcctccatcgccttttacggcggcttcaacctggacatggataggtcacccggtttcgggcctgcacgtactgactaaaacgccctcttaagacttggtttccctacggctccgcacctgaagtgcttaaccttgccagtacccgcagctcgccggaccgttctacaaaaagtacgcggtcgtacctgagaagtacttccacagcttgtagacacagggtttcaggttctctttcactcccctcccggggttcttttcacctttccttcacagtactatacgctatcggtcactgagtagtatttagccttacggagtggtctccgctcgttcccacagggtttcccgtgtcccgtggtactctggatcctgccgggtcagctctggcttcggatacggggctctcaccctctctggccggctgttccaaagccgttctcctgccgttactgaatcccttatgcagtccgaaccccgcgatgcacgcatcacggtttgggctcttccgcgttcgctcgccgctacttacggaatcgatgtttctttctcttcctccgggtacttagatgtttcagttccccgggttcccttccataagctatggattcacttatggatgactgtagtccatacagccgggtttccccattcagagatctccggatcaaaggatatttgctcctccccgaagcttatcgcagcttatcacgtctttcatcggctctcagtgccaaggcatccgccctgcgcccttcttcgcttgacctttgtatgtccatttctaagaaatggctacctcctgttcctcctagcgtagagaacattcggcgtatgagttaaaactcatgttttcgtctttcgacttgctattgggagaattgatatatttagtctcaattctttcttatcatagaaatctgatgtcgcttttctttaagaaaaactttctgtgtgcagttttcaaggtacgaattgtgataaccattcaatcatggttatctatgggcttaagtgaacctttccttcagattgaaggctttctttctctttcaccctatgggctcaagtggactcgaaccaccgacctcacgcttatcaggcgtgcgctctaaccagctgagctatgagccctcagtggagaatacgagattcgaactcgtgacctcctgcttgcaaggcaggcgctctcccaactgagctaatcccccaagggaatccggcagccacctgctctcccatgccgtctccagcatagtaccatcggccgctcaggtcttaaccatcgtgttcgggatgggaacgggtgtgtcccctgagcgcatcgccaccggaaatatcttatcaagtttttgcttgataactgaataacaaaacaactctctacttgtcttccttagaaaggaggtgatccagccgcaccttccgatacggctaccttgttacgacttcaccccagttaccggctccaccttcgacagctccctccataaaggttaggtcactggcttcgggcatttccgactcccatggtgtgacgggcggtgtgtacaagacccgggaacgtattcaccgcgacattctgattcgcgattactagcgattccagcttcgtgtagtcgggttgcagactacagtccgaactgggacggcctttttgtggtttgctccccctcgcgggttcgcctcactctgtgaccgccattgtagcacgtgtgtcgcccagatcataaggggcatgatgatttgacgtcgtccccaccttcctccaggttatccctggcagtctctccagagtgcccagccttacctgctggctactgaagataggggttgcgctcgttgcgggacttaacccaacatctcacgacacgagctgacgacaaccatgcaccacctgtctcttctgtcccgaaggaaagcaccgattaaggtgcggtcagaaggatgtcaagacctggtaaggttcttcgcgttgcttcgaattaaaccacatgctccaccgcttgtgcgggtccccgtcaattcctttgagtttcattcttgcgaacgtactccccaggtggaatacttactgcgttagcggcggcaccgaagcctatacggccccgacacctagtattcatcgtttacggcgtggactaccagggtatctaatcctgtttgctccccacgctttcgtgcctcagtgtcagtaacagtccagcaggccgccttcgccactggtgttcctcctaatatctacgcatttcaccgctacactaggaattccgcctgcctctcctgtactctagctatgcagtttcaaatgcagctccggggttgagccccggcctttcacatctgacttgcactgccacctacgcaccctttacacccagtaaatccggataacgcttgctccatacgtattaccgcggctgctggcacgtatttagccggagcttcttagtcaggtaccgtcattatcttccctgctgatagagctttacataccgaaatacttcttcactcacgcggcgttgctgcatcagggtttcccccattgtgcaatattccccactgctgcctcccgtaggagtttggaccgtgtctcagttccaatgtggccgttcatcctctcagaccggctactgatcgttgccttggtaggccgttaccctgccaaccagctaatcagacgcgggcccatcctgtaccaccggagtttttcacacaaggagatgtctcctcgtgcgcttatgcggtattagcagccgtttccagctgttatccccctgtacagggcaggttacccacgcgttactcacccgtccgccactcagtcaccaaactttcatccgaagaatcaggtaaggtgcttcgttcgacttgcatgtgttaggcacgccgccagcgttcatcctgagccaggatcaaactctcaaataaaatgttcaagatgtcagatcaaagtccagaaccactggttcttttcctgtcattactgtttatttaggttttgaactttcgttctgttccatggactttcctgcagacatcactctcaggaaaacccgaatgaaatttgaattaacgttcaaggttgttttgttattcagttatcaaggttttgtgtgttcttttttttgcgacacaacttctttattttatctcattcagaagtttttgtcaagaacttttttattttgctgtttctttctttcgaaaacagcttgtacattttatcattctctttcaagaatgtcaagtacttttttgtgattaataatcacaacggagaagaagggatttgaacccttgcgccgctattaacgacctactcactttccaggcgagccccttcggcctcttgggtacttctccaaatagtcaacaaaacttattcaaagaggatgtacaaaccaatgacttcctatttaaatagatgatacggagaaggtgggattcgaacccacggtacctttcagtatcactggttttcaagaccagctccttaaaccactcggacacctctccatatgttttttattttgttgcgctctcacaagcgactcacttatattatcacttctttttgcatatgtcaacaacttttttcaattttttttatttttttgatttgctttttcaatagacgaaaagtgcaagtttgcgggtttctttggttcgtctgtttatcctcatcccaaatactttctcatcttctggttaagtttcttataaattggtttcatccacgcttctgtggatgaacgtaccgcttcatctggagaaagccagcccaccttgctgttttcctccgggcagatttttaatttttcttcttttgtgttatggagaagaaaggtgtagtttagatgcaggtgtgcgctgacatatttctgttttttataatgtggctggactcctagaatttcgatggaaattggagagtctgacaatggttttaaggaaacaaggccgctctcttcttttacttctttcattgcaacagataaaaggtcaccttctccatctgcatgacctccgctccaggaccatgactgataaatattatggtagagcatcagaactttattcttagatgggtttaatacccatgcagatgctgtaaaatgcatttttacattatcacgcagtaaaagattctcttcttcctctaaaaactgccttatgcgctgacagtccacttgttcctgctcattaaaagatgtaaatgtgttaagccactcttttatcttttttaaagaattcatttgctacctcactttttacttcatatactttcacaatttctattttatagctcattaaaaaatatgtttaaaaaatattttctaatgagataaagcgcgtttggaatatacccgaaaagtgcaccagtctgttcattttaatttatcaacagaccgctgcactactgtctatatgtatgaatcggaatagttatgtactattttcttctttccctgatattatttaaatgtttcatcacatcatttataccagttccaaagtaagtatgcaaggttttatattcttcatagagttcattatagatttcaacgttatcctgatttggctcccagactttatcttttacttttccaagcttctttgctgcttcattagcatttttaaaacctgtaatacgctccggagccgctgctgcacctaaaattgccgcaccaagggcacttgattgtgtagaatcaacaactttaatttttcgattacatacatcagaatatacttgtacaagcatttcatttttgattggaataccaccacttaatgtaatgtcttttacttctaagccggcttcctcaaatccttcaataatcatacgggttccgtatgccgttgcctcaataagagaaagatagatttcttctggttttgttaaaaggttcattcccataataagaccatttaagttaaagtccattaacggagtacgcacaccattaaaccaatctaatgccaataatccacttgcacctgctttgtatgtggacaatttttcagaaagaagctgatggatggagataccacgaacacgggcttcctgttcataactttccggtacacagttttcaacaaaccatgcaaaatggtcaccaacacaggactggcctgcttcatagccaaaatatcctggcataattccgtcttttacagttcctgatgaacctttgattgcgacttctttttcaccgagcatcatatgtacagaagatgttcctacaataatcatcattttacccggctctccgattccacagcctggtaaggatgcatgtgcatcaataatgcaggttgctactgggattccttccatgagccccatttctcttgccattgaagctgttaaatgtcccgctttttctcctactcctttaattggagcatctaatttatcagcaacgatattttccattcctgggtctaccgctttaaagaaatcttttgatggatatcctttttcatgatgataatatgccttatatcctgcgcagcaggcacttcttgtttcttctcctgtcatctgccagataatccagtctcctgcctccataaaacgatcagccgcatcataaacttctggcgcatgacgcagtgtttcataaatctttggatacatccactcactggaaattttgccaccatatgtcggaagccattcttctccacgtgctacagcaacatcattcatcaattttgcttcttcttccgcaccatgatgtttccacaatttcacataagcatgtggttcctctttaaattctggaagatgacatagcggtgttttgtctgctttcaccggaattaccgtagaagaagtaaaatccactccaatacctacaacttcccccggaagaattttatttcttgaaacaacatctcttactgtaacaagtaatccttccaaataatcttgtggatcctgtaacgcccatcctaccggaagcttttttcctgacggaatatgttcttccataaccccatgtggatattcataaatacttgcagccacttcttcgcctgtttcaatatttacaagaagtgcgcgcactgataacgtaccataatcaatcccaatcgcatatttactcataagtattctccttctctttcccaactgatactattctgctaaagaaaaatcattccatgtaaagtctttccacggaatatttacttctgctccctgattgatgattgcatctacatgcatcaataatgggaagtcctctaaagaaacaattcctctttctgcaagctttcttacggctcttgctgttcttgtggaaataacgatagactctaatgttaccccctgtaattctgccatcgcttcctcaaaagaaagtccacgtcctaataaagtaccaatcttacgagttcttccaccaaaaattgttacatataaatcgcctgccccgtgaatgatattttctggcttaccaccgattaactcaagcagttttgtcatttcttttacgctctgtccaaataatgctgcctgagaattgtaatgctggcttccaatctttccatctctcttttctgcaagacctaccgcaagacttacacctaatgcatatgcatttttcatagcaacggcacactcaacaccaacaacgtctgtagaaagggaaatatgatagtaatctgtctctaaaagagatttgatatattttaatgtctcgatatcttttccacagaaagcaacatggctgtcatcatggtctgctaattcataacttgtacatggaccaccgattgcatttaaattaagatgtttgccctctggctgtctctgtgcaaaaatgtgcggataaggaactaaggtaccatcttctaagtcaaccattccttttgttactgtaagaactggaacgtcttctggtaatactggaagaatctcatcacagaaccagtcaagaccaaagctgctcacaccgccaagaactaaatctgctccctttaatgcttcttcaagttcttcaatctgataatatttgataccgtcatgaagcgttctctttaatgtgatgtggaaattatctttctttaatccatagataatgtctctgtcaagaggagaaccaactaatcttacctcatgaccattttcaaaagctggaaaagtaattgctgaattcatctgacctgcacaaacaaaagtaataacactcattttaaatcctcctgtaaaaaatcttaaataacatctttgttttgttttttgtttcgttatctgatgactacatgtaaccacatttttttcctaaagtcaaacgacagaattcgcttatttactaggtattcgcgtgctttttattaatcatttcatttgattaatcccctgttttttcgctccatttttcttcctgctaaaaaaggaaatgcaaacataaggaaatgccttgtaaaacgaattaatcaatactataatattattaatcaaaaatgtactaagattaatacgcagctattaattaaaataaatcaaaaaaggggtattttttatgggaaaaaggaatcgagtcactaccagagacatcgccgaggaacttggaatctcccagtccactgtctctatgatcctcagtaataaggcgaatgtgtcctttaccgaagagaccgtacaaaaagtaaagacaaaggcaaaagagcttggatacaaaaaacctgtaccaaaagaactggtacaggaaaaatctcttgcaaatacaattgtcgtgctatgcccaatggtaacaaatggctattactcgatgatgatgcagtctatcactgaccatgcgaaagaatatgattatactgtcatgactatttcaaccggaagagatgccgccacagaggaactctaccttgatttatttgcccgtgtgcagcttgccggcataatctgtctctatccactgtcaaaaatccagaaaatcaatgccctctcaaagcgttttccggttatctctgttggggataagcctctttcctgtcagtttgactctgtggaacttgacagccgcaaacagggacatattatggcaaattatctgctttcgcttgggcacacggatattacttacatctctacgccgattcgaggaaaggaaattggacgaattcaccggcttgatggtgttaaatccagtttccgggaacatggtattcctttagaacatcttactgttctttatcaaagccaacctgcctttgaccgctatccactggaaaatgcggaataccagaatggttatgatctggccacacacgctttagaagaacacacttcttccactgcgtttatcggcaacaatgacatggctgcctttggaatcatggcagcaatttctgaccacggttatcggattcctgcagatttttccgtctgtggctttgataacatcaccttatctgccatgccacagattgcactgactacgattgaccacgcttcggtgcgaaagggcgaagaggcggtggatatgattcaccgaaagaatacgcagaagaaagatgagacttcccacgcttatattatgcggctggagtatgaaccacagttgattgtgcgcaaatctacggggagaaaattctagttgccgtaggcaaatcagtattcattcaacggtacatcttcatcaaagggttcaatttccttaatctcaacataatacccatactgtgcatttaccggaatatagactctctcgccctttttatgtccgaggagtgcctttcctaacggagattcaatactcacacggttttgcatcgtatctacaagtacagtagttacgaaggagaatttatcggtttcgtcgtcttcttcgaagtagagagttaccgttttgtttaagcctacctggtcggcattggagtggtcttctacgatttcacaggttcggatcattctttcaaggtaacggattcggctttcgtttctgtttttttcttttttggcagcgtggtattcgaagttttcgcttaaatcgccatgtgctctggcttcttttacatgttcgagcagttccggtcttacttcgactttgcggtgttcgatttctgctttcattttatctacatcttgctgggtgagtttatgtttcatgataatttccctttctgatatatttttgtattatattttttgcattacaattcaatatatctattccgttacttagatatattgattctgttacgaagaaatactctttaaagattggacattatttttataattatatcctattgccagtatccttaccttttatagtctgtatggttttttctttttctgctttatctacctgataaaaatatattaatacgatttcaattccttccacagccgattataatactgatctgtcttttcaccaagatatttatatacttcgcatttatccaatgtagcttcttccgggaagatagtgtaatcttctttggtgtcatcatctaaggtgtcatatacagctttatttggtgttccatagtaaatgtaatcaaagtttttctgggcgatgtcctgacggttcatgtagtcgataaatttttcggcagcttctttgtgttcggctgttttggggattaaaaagcagtcaaaccagacgttagagccttcttttgggacaacgtagtcgaggtcttcgttttcttccatggcaacggtagcatcgccggaataaatgacggccatggaggcatcgccagaaaccatggcatctcttgcctcatcaacaagataagcttctacgattggtttttgttttaataaaaggctctgtgcctgttttaattccttttgactggttgtgtttaaggaaatgccattccatttgagtggaaccataaaagcatctcgcatactgttttgcataacaatctggtcatcgtattttttgtcccataaaatgctccagctatcgactttttcttttatgacttttgtgttatagaggattcctacggtcccccaaaggtaagggactgcgtattcattggtcgggtcaaatgccttacagaaatctaaatacttttcatcaatatttttatagtattccatagaggaagtatcaattttctgtgcttcgccctcctgcatcattttctctaccatgtagtcggatgtacaaataacatcgtagttaatgacaccggatttatattttgtatacatatcttccggggtgacatattcttcgtattttactttgatgccagtttctttctcgaaagtttttagtacacttacatcaatataatctccataattaaatacggtaaccgtatttttgtcatcgctcttttttccagaagaaaagcagccggtaaaggcaatggttgagataattaacaatactacgaggacgaaaatacctgccatcagctttccttttccctgcagataatatttttccagtaaattcatcgattttcctccctgtctgcttttttctgttttgttgcggacatatggttaatgagtccgagtaaaataagaattgtcaagaataaaagggttgaaagtgcatacatctgtgggttgattcctcttctaagctgctggtaaagcattgtggaaatcgtgttgattcccgctccctttgtgaagtatgttacgacaaaatcatccatagataccgtaaatgcaaagaaaaatcctgaaaggattcccgggataatttccggcaggacaactttgacaaaggcgtatactgcggatgcacctaaatcctgtgccgcctcgtatacatttttatccagctgctgaaatctcggcatgacatttaaaatgatatagggtaatcctaaagttacgtgtgctatcaacatggaagtgaatcccagtgacatgaaatgcacaaataagagcatgatagccacaccggttacgatatcggcatttaataatgggatatttgaaagtccttccattaccttttggaaacggagcttcatcgcagtcattccgatacacgcaagtgttccaatcaatgtagcgattaaagccgccaatgttgtaagcagcagggacgttcttacggctgaaagtacttcctcattctgaaataaatcagtataccagtgcaaggtgaagccgccccaaacggttcttgatttagaatcgttaaatgagcagacaaataacacaagtaacggcgcatacaggagaaacccaataaatgccacataaaatttttctataaaactttttgcttttaccatagcatgttgtctccttcctctgacgcgtggcggttcataattgccatactaataaaaataaatatcataagtacaatagaaagcccggaacctaaattccagttatttgccacattaaattcctggtcgataacatttccaaataaaagaactttggacccacctaaaatatcagccacaacgaactcggaaatgcttgggataaataccataataattccactgatcactcctggcagagaaagtggaatgataatcttctggaatgtcacccttgcgcttgctcccaaatcatgtgctgcttcgataacgtctttgtcaattttgcaaagggcattgtaaatcggcaaaatcataaatggaatatagtcataaaccattccgaccaaaactgctccttttgtatacattaatttttgtaaaggaagtccaaaaaatccgagaatggcatttaatattcctgtttttgataaaataacctgcaatgccagtacacgaagaaggaagttaatccacattggcaaaataaacagcataatgacaatgccggaacctctatgttttcccttacttaaaatatatgccaaaggatacgagataacgagacaaatgagtgtacttgctaacgcaatccagacagaattccagaacgctttgtagtgaacggaatcagccattgcggtaatattagaaagggtaaagcttccgtcgcttcctgtacagccataatatagcaccataaataatggcaaaatgataaatgctgctccccacacaatgtaaggagttgtaagaacttttctactcatctatcgtcaccgccttttcatcttcggattctggcttatgcataatctgaatattaaacggaatgacggaaatgcttactttagatcctactggatgacagtttgtgctgtgaacaagccactcatatccatttgcctccacttccatctcgtaatgtacgcccttaaaaataagagaagtaaccacaccatcaaggattccctgaccttcctcaccaagaaccacatcctccggacggattacaacgtcaaccggacgatttcttccaaaaccttcatctacacattcaaactttgttccaagaatctctaccaaacggtcttctaacataataccgtcaataatattactgtcaccgataaaatcagccacaaatgcattttccggctcattataaatgtcttccggtgttcccatctgctggatgtaccctttattcataacgataatcttatcagacatggtaagtgcttcttcctggtcatgtgtaatataaataaaagtgattcccagttcttctttcaaacgcatcaactcatactgcatatcctgacgaagctttaagtcaagcgcaccaagcggctcatctaataacaagactttcggttcattgacaatcgctcttgcaatcgcgattcgctgctgctgtccaccacttaaagaagttggctttctcttctcaaatccttccaaattcacaagctttaacgcatatttaatcttatccttaatgtaggaatccgatttatttttaatctttaagccaaatgcaatattttcctcaatcgtcatatgtccaaataacgcatacttctggaaaaccgtattcaggtttcgcttattcgctggaacatttgtaatatccgctccgtcaaaaaagacttttccactgtctggtttctcaaatccaccgataatacgaagcgttgttgtctttccacagccggacggaccaagcagtgtcaggaactcattctcttttacctctaaacacaactcatctaatactttggttgaaccaaaagactttgaaacattcactaactcaactaacttattcttcattcccatttcctcaataaattttactatatttcctgtctaaaaacttggcggcgaagtcacccagattaattccgtccgctcaattccctttaaataatgcgtcttatctgccctgtaataaaaagcatctcccttttgggcaatacagattcgctttcccagatggatttctactttaccctttaagatatagccaaactcttctccctcatgggggttgtccggacaggtctctccacctttttccaaaagcaaatgaatcggctccatgcagttcttctgtgcatttggaataatccacttaatctggtttttatattcttcatccttttttacaaaaaaatcctcctccgtaaacacaatctgttcctcttcctgctcttcattgaaaaactctccgagagttgttccaagacattgcagtaaatcttctaacgttgcgatggagggagaagtcatatctctttctaactgggaaataaatcccttactaagctctgcccggtcggcaagttcttcctgagtaagtccttgcttattcctcaattctttaatcttctctcctagttccatgattcatgacttcacacctttctatttatgtaataataaacttaaagtttagtatagttaaacttccaaagggtattatggcagaaagaagtgtgctagtcaagagagaattaatttcgaatttgccgcaggctgtctttggctgttggtgtgaaatcgaaatttaagttttgcttcggtaccatatactgactagacacttgcggaatgggttggggatggggacaggagaaataggaactctgataaattctgcgtttgcataggcgaccaacaaacagcccgcagaaagagaaacaacctatatttgtgacctgggagcaaaggttggatgtgagcgattaagcgaacattcaacctgtagcgacgaaagtcacaaatataggttatttctctttctgtgggcgtctaccttgcctgcggcaattcaagctttaaaatggtatttcttttccagcttttctccactgcataaattctgctgttgcagtaagcagtacatcagaagatgagttcagggctgtctcacaggaatcctgaattacaccgatgataaatcctacccctactacctgcatggcaatatcattggagattccgaaaagggaacatgctacagggattaacaggagagaacctccggcgattcctgatgctccacatgcggaaagtgttgctaagatacttaatacgattgctgttggaatgcttacgctgattccaagtgtatgtgcagctgctaatgtcattactgtaattgtgattgccgctccgtccatgttgattgtagaaccaagtggaatggatacggaatagttatctttatctaagcccattttttcgcaaagttccatatttacaggaatgtttgctgctgaacttcttgtgaagaatgctgttaatccactttctcttgcacaacgtgaaattaatggatatggatttttcttaaggcaaaatcctacaataataccatttgtgataaattcctggaataacatacatcctacgagtaaaaggatgagttttccgtactgtgtgaaaatcttcataccacttgtggatacagcattaaatactaaacctaaaataccaaatggagcaagattgataatccagcgtactgcctgagatactgcatcagaggcatcagagagcatctgttttgttcctggtgtagactttttaagagcgattccaagaataacagcccatgcaagtactccaagatagtttgcatttactaatgcatcaattgggtttgctacgatttttaaaaggagattttcaagtacttctacgactccttttggagcttcctgctgtacagcatctgctaatgtgatttttaatgggaataagaagcttcctgctaccgctacgattgctcccattattgtactgaacatataaaggattactacagttttcatgtttccgttatgtccttcttttgtctgagctaaagaactcataattaaaagacataccagtaatggagcgattgcctttaatgctcctacgaaaaggtctccaagaatcttgattcctgtaaattgaggcacagcaagtgccagcaccacaccgattgccataccgattaagatacggatgatcagactggtctctgtatatttatttactattctttttaaactagatgtttccacttttttcctctttcaatttaatgttttttagttacacttcttcctttacccacgcaatctttccggcaagtatttctgcaatttttgttacgaccggctgcatggcggtaagggcgtcttctcttgtctttccggatgcagttactcgtattaatacgccgtcttcttttgcgtaagttgcgactgtcggattctcattatcaaggatgtctcctaataaatctgcaactggtgcttctccaatctctcttaacggaagctcgtccgggcctttgcacttaatgttgattgatacaaatacctggtcggaaagacggttaatgaaaaggtgacagcactcggcaagaacagccttcatctcctttggcggacctggcagcataacgattgccttatctccctgtgccataatgattcccggagcaagtcctgcaggattggtaactacaagagaaccttctgggactaatgcctgttttttctggctttctgtcatctcatttattccataagattccagtttctttctgacgtgttcatatgtctgctcatgaaagactaatttcttcccaaaaaaagatgccgctacttctttcgtaaggtcatctttcgtcggaccaagtccacctgtcatgataattaggtctgaacgcttcaaagctgtgtctaatacattccacacgcgttccttattatctcctaccactgtctggtagtataaatcaattcctatatgggcaagctcttttgatatatgctgtgcattcgtgtttacgatatctcccagcagaagttctgttcccacacatacgatttctgcaaccatgttgatatcctcctatctaatttgaaattttccgtgaaaaaatgtgcagccatttctctcacatttaccattataacagatttcttaaatatattcaccttttatatgaatatttttatttttttaagttcatccttttatacagatgcattttctattgcataaaattctgaaagtacatgttcatcttaggaggatagcgatgtttttaaacaaagtggaaatctgtggagtaaatacttcggaactgcctcttttatccgatgaggaaaaggaaaatctattcatacaaattgaacagggaaatatggatgccagagaacaatatgtgaaaggcaatctgcgtcttgttttaagtgttatccagcgtttttccagcaatcacgaacatgccgatgatttattccaagtcggctgtatcggtcttatgaaagccattgataattttgaccgcactttaaatgtaaaattctctacctatgctgttcctatgattctcggagaagtccgaaggtacttaagagacaataacagtatccgcgtcagccgctcccttcgtgatactgcttacaaggcaatctatgcaaaagaacagctcactaaatcaatgaaccgcacccccacgattgaggaagtttccaaaaaaacggaaattcccgaggaagatattatttatgccctggatgcgattgccacccctatgtcccttttcgaaccagtctatcaggatggaaatgatcctctgtttctgatggatcaaatttgcgacaagaaaaataaagaagacacctggatcgagcatctctctctccaggaagccatgaatcagctttccggaagggaatatcacattattgaaaaacgattctttgaggggaaaacacaaacagaagttgctgatgaaatcagcatctcgcaggctcaggtgagcaggttggaaaaaaatgcactgaaatctattcgaaactttattgaacggtagttttacaggcaaaatagacactctcagagaagaaaagaatctatatttgtgactttagtcgcggcaggttgaatgttcgcttacccgctcgcatccaacctttgctccgaggccacaaatatagattcttttcttctctgagagctgtctttggctggacagaattagaaactactgctcgacttaaaagattctcttccagatatatattttttcagatttacactttattaagaaatcagagacaactagcgattctccgatataaggatttttctcaacatttaataagacttgaagtcgttatgaagaatttccaacccctccaatatgcaatttcactccaacagccaaagacagcaccgcaaaagagagcatagcctatatttgtggccttagagcgaggattgaatgtgagcatagaggcgaacattcaacccgcagtgatagagtcacaaatataggctatgctctcttttgcggtgcgtctctccttgcctgcagcaacccagaatttactgcattttaatcatctcccgcttcaaccgatggataatcttcttctccagcctggagatataggactgtgaaattcccagcaagtctgcgacttctttctgcgtcttttcttcgctttcctcgcctcctatcccaaaccggagccgaatgataagtttttctctgtctgataaagtctccatcgctttatttaacattttccggtcaatctcatcttcgatatcttttgagatgacatcgctgtctgttcctaaaatgtcagaaagaagaagctcattaccgtcccagtccacattcagcggttcatcaatagaaacttccatttttgttttattggttcttcgtaaatacatcaatatttcattttcgatgcatcgtgaggcgtaggttgccaatttgatttttttatctaatttaaaggtctggattgctttaatcagtccgatggtaccaatcgaaatcaaatcttctactccaattcctgtattctcaaatttctttgctatgtaaacgactaatcgtaaatttctctcgattaaaagtgcttttgcttcctcacttcgtcttgtatctaactgacttaacacataagcctcctcttctggctctaaaggcggcggcaaaatatcggttcctccgatatagtgaatctcccgctgaggatgaaataatgacttcatattatttatgactgtaaatcttacccggtttactcctgatgcattcaatacaactgccatgctcttaccctccttaaatattacgatttattttaggattataatatattactactttcttctctatcgaaaatatcatttggaagcaggacgaaaaattcttttgtttctgaaagttcctcctgactgattccaagcattccttttgtcctggtaagcacctccccatcttttaacacaacaatttcttcggccatgactcccggcatttttgcatttttcttcccaacagttgaatactgtagtacataaattcctgtctgaaactgttttgcccacattctccataaaggctgttctatttgctgcttcttttttccattcttttctctcttcttttcttctttttcttctgaaaactgtatataaatctgctctatctctgacttttctttcgtcaatagcagttttgctgcctgctctttttgtataatgcagactccctgtccggtaatctgactgactaaaagattccctgaatcatagatacctttgtatactgcttttctcccttttctcgatattctcacttcataggtatatgtcttagaaatctgagttgcattttcttttttctttttcattttccatagaaaaatcactcctgcgctaaaccatataactgccatcgctttccacgctgtttttcttccaccgaccgtttttatatgtatgcaggataaaaaaaaggaaaccgctccacccatcagaaaaagataacacaaaaatagactgattgtttttcctatttttttaacggaacgtattttaaaaagaatgtacagaatgctaaaaatcaggaaccattttaaaataattctacaatacgggggcaatttccctgctgttccttcccacagaatataagagagggaacaggccgatgccccgattaaaattgtcctgttttttatttctggatataagtctttttttacaaacaacagcaaaatataatctgctgcccaattatataaaaaagaaaataggaacggatattccgttttcatggcaccttctattgctatgtggttaatttattatataaattgacataaaaaaatgaggtcgaaataataaagaaaaaatctttaatattcgacctccggcgacaacgcctgcctaaaagagtgaaaactctttatattctgttgttctcttcgaccttatcttcttttctgcaaaaattctggaatcttaatctccatatctctgttatcatatgttctcgaagattctcggctgtcactgctacggcctgtaccagtcttgatagcctgtccactgtatgtaggaccattactttctgcattattcttatctgctgctggtttacggactttcaccgcagatgctcccttaccagaaacatcatgaagtccggttgcaatgattgtaatgcttacttcatcatccggtacatcttcactctctacattaccaaagataatgttcgcctcatcaccggcaacttctgtaagataagatactgcctcataaacttcctggattccgatatcacctgagaagttaatgataatatcggttgctccactgactgttgtttcaagtaatggactttccatcgcactcttgatcgcatcaacagccttgtcctcaccacttccaacaccgattccgatatgagcgattcccttatctctcattactgtctgaatatcggcaaagtctaagttgataagtcctggcttaaagattaagtctgtgataccctgaacaccctgctgtaaaacctcatctgccttacagaatgcatctttaatagatgttctcttatcacaaatctgtaatagcttatcattaggaatgataattaaagtatctacgttctctttgagacgttcaataccattgagtgcattattcatacgaggcttaccctcaaaaataaatggctttgtcacaacaccaacggtaagaattcccatctcttttgcgatctctgctacaacaggcgcagcacctgttccagttccgccacccataccacaggtaacaaataccatatctgcttcttttacgagttctgtaatctcatcacggttctcttctacggcagcagcaccaatctctggcttggcaccagcgcccagtccctttgtaagcttctctccgatctgcactcttgtaggtgccttacataaatcaagagcctgtttatccgtgttgattccaatcagttctaccccttcgatagcttcgtcaaccattcggttcactgcattgttaccggctcctccgactccgataaccaggattttagcttgtgctaattcttcgtttgacataatttccagcaaggtttactcctccttattctatgtaaatatataattcatccaattttacttatcataaatatataatacgtttttttatagaaataatcaactaaaaaaattggatttttgcgtttttttctgacttctatgaaaattcccataattgccttgaaaaatcaggaaaatatcgccagatgttctttgtctcttacttatcattctctttaaaagtgacaatcggtttatcatctgtatataaatgcatatcaatggttccttttttgtaattagaagaaaccgtctcaagtatagaagaaagttttgacattttaccatcgagataagaagagcttcctaaatatatcttatattttgaagaagttaatgtaatatcatcttccccttcaaaatgtatttctgaaacatttagtttatatgtcgtaatttttttcgtaatagatacgatagtattaaaataattcttttttaccggaactttattttcaagtatctttcttttcagattcatctcattgaatttgacaccggttacaaccggaaccccctcaaacagagtgtttctactctccatcgcaattccattttcattaaaatacacatattcattcatgtatttaaaaacgcctgtccgaagtttctctttcacttttaccttcagtatgtgactgtcgtcataactcattgatactttttcgataaatggcagataggtctgatcaaaaatctgattctgtgcgatcatcagcagcgtgttatctatatatccatcctctttcatcgcttcaatgatttcggcattcgtataggtattatttcctgaaatctgtattttctgaatagaaaaatccgtaataaggaaataaatacccatccccaaaacaaccgccagacaggcaaaaagaagaaggatatgccgctttctgggcttattatctgccacaagttttaaatttctttcccccatctttttctcctatcttttactttttcacgtttatgtaacgggatactgacagcaccagtcccatctctaatagcataaataccagcgaacttcctccatagcttatgaatggaagcgggattcctgtattgggaatcgtgtttgttgcaactgcaatgttgataaatacctgaataccgatatgggcaatgactccaacaacaatcatagaaccgtaaagatctggtgcattcacggcaatcaccataaagcgccatatcagcgcaaaaaacagagctagcacgcacaacgcaccgaaaagtccaagttcctcgcaaataacagagaaaatcatatcattattcgcttctggaaggaatccaagcttttgcatactctgcccaagcccctttccaaacaggccaccggaaccaatcgcatataatccctgtatggtctgatgtcccttttcagaagctgctggatcaagccacactgtaatacgctccatacgatatccctgtgtgagaagaagtcctcccgctccagccactccaataagaccaataacaacgaaaggcaccaacagaggtgtagccacaaaaatcataataaaagagattgcaagaagaataatacaggtactcagattctcaataccgacaattacgataatcggtattgcaaaaagaaatggaataaccatcttcttccattgtcgcatttctcttgatttactgctgatataagctgccagaaaaaggatgattccaattttggcaagctcagaaggctgtaaactaaatggcccaatcgaaatccatctctgagaaccatggctcgctgctccaatcgcaaaagtaagaagaagcaatccgatgactccgccataaatcacccaggcaaaccaccattttttctgccagatatgataatctctcgtagcaataaataacatgccacagattcccatagcagcaaaaagtgcctgctttttcacccagtatgtcgtatcattatacaggagacttgccttataggaactggtggaatataaaattacaagaccaaatcctaccaggaaaagcaccaggaataatatagaataatccatggcctgtggccgtctttttggtttcttccaggatttcttctgcacagcattcaccccttaaactttcggacgatttctttaaataccttgcctcgaacttcataatttttgaacatgccccagcttgcacatgccggtgaaagtaaaacagcatctcccggtcttgccttctcttttgcaatgttcattgcttcctcaaaagtatctgcaaaaatgacgttatggaaaccgtgattctttgccgtgtctgcaattgcctgtgccgttgcacccataacaataagataacgtactttaccatggaatgcatcgatccactcatcataagtagacttcttatcatatccgccgcctagtaaaatcgtaggctttgtcatagctgagattcccttgattgccgcatccgggttcgttcccttagaatcgttataataatctacaccatctaccgtatccacatattcaatacggtgctctacagcagtaaacttcataacagcatccctgatctgttctacaggtactcccatataatatgttatgccgatagctgccagaatattttcatgattatgagaaccgagtaattttatctcagaagttgtacatacaggaagctcctttccatcttctttaatgataaaagtatctcctcttaatacaattccctcatcaagttcttctaaacgactgaacatgacaggtctcgctgttgcttttttagccatctctctcgtgattggatcatcataatttaatacgataacctgctctttattctgctttttagaaatggagaacttagtatctgcatatacttccatcgtaccatgtcgatctaaatggtctggagttacatttaatactgcacttacttctggctggaaatcaatcgttgtctctaactggaaactgctgatttctgctgcgatcacagaatcttctgttgtatctaatgcgacggaagtaaatggaattccgatgttacctactacaaatacagacttatagtattcgcgtaaaatacttcccactaatgcagtagttgttgtctttccatttgttcctgtaatagcggcaatcttaccctttgcaaaatgcgctgcaagttcaatctcgccccacactggcttctttctgtcatagaaagcttttgctaccggtttatgaattgaaattccagggcttaaaatcagcatatcgtatttatctgctaattcctctttaaattctcctaactcaaaagaaatttccattccttctggaagctttgcagctactgcctccttatcaagttcttcattcccatcgtatattgctgctgcaattcctgcttttcctaataaagctgctgcaccaattccactgattccggctccggcaatcagtatcttttcactctttaaatccatgttaacctccaagtttcgtatctttaaataaaaactccacaaatgtggttgatctttatattttagtgtttatattttataatatttctctttaattctataagtatctttttatagctctaaaccatgtgttttagagcgtgtttgaaaaatgctttctgcaagatgtgtgttacaatttgtggaagattttacccgaatgaggacggcgtagcgagctcgggctacgtcaactgaatgaaggcaaaatataccgcaaattggggcgtgcagattgcagaaatgatttttcaaacactctctagtaagcaagcataccaatcagacataaaacagccgttacaatagaaaagatagaaactacctttgtctccggccatcctgataactcaaaatggtggtgaattggtgccattttgaaaatacgcttctttgtctttttatagtatgttacctgaatgataacagaaagtacctcaatgaagtagataaatgcaacgattggtataaacagaggaatctttaacatatatgctgcagatacgacaaatccacctaatgcgagagaacctgtatctcccataaataccttggctggatgtgtgttaaagcataagaatccaagtaaggcaccaattaccgcacaaattacaggatggattcccgcgtttgttccaacagcgatcactgttaaaaatactgcaattaatgtggttacgcttgctgcgagaccatccagaccatctgtaaagttcgcaccattaactgttccaagtacaacaacaaataaaattggaatatataagattccaagatgccattcctttcctccagaaaatggaataattacatctgttccaagtccggaatgattcaccatgtaaaaggcaaatacggctgtaataacaatctgtccaagcatcttctgtgctggtgtcaatccaagattccgcttcataacaaccttgatatagtcatcaagaaaaccaattaatccaaatcccagtgtgacgaaaagaattgggataatctttttgtaatcagaaatatagaacgcacttccgactaagattcccactaagaataagattccacccattgttggtgttcctgactttttcagatgagattccggtccctcttctctgataaactggccaaatttcagcttatgtaagaaactgatcagccccggccctaatattaatgtaataaaaaatgcaactaatgctggtattgcaattgaatgatccataatctaacctccattttatctctttgtaatttaagacattcttacacagtataatcctcttttcacagattatcaagatatggcaggacattttgaaaaatttctgccataaccggtgctgcgatcacacccccatagtaagttccctgcggctcgtcaatcagtacaagacctaaaatttggggatgattcgccggtgcaaatccaagaaaagaggaaatatatttgccacttcttcttggaagcttctcacttgttgccgtctttcctcctacccggtatccttccacctgtccgttctttcctgttccttctgccaccactgcttctaatacttcccttaatgtctgcgatgtttcctttgaaacagctcccgccttttctttatattcatactctgtaatctcttttgttacaggatttttcttctctaaagcaaaatgcggtgttacaagtcttccatcattaattcctgcgctgaccgcccgcataagctgtagtggtgtaatctgtatcgactgcccaaaagacattgtagccagttctactgcaccaatcttatcaagcttatgcataatggaatttgcctctcctggaagatccactcctgttctttcgtaaagtccaagcttgtggtaatagcgaagcatatcttttgccccgacccttgccccaatttccatgaaaaccgggttgcaggagttcataactccctgcttaaaagtttctgagccatgtccctgtgttttatgacagcgtatctttctatcttctacgattttaaatcccggacagaaaaaagaatcctgcaacgttacttttctttcttctaaagcggccgttgccgtgataatcttaaatgtggagcccggttcataggagtcactgatcacaggatttctccacatatcatttagcttatcattctgattctttccttcggcctcatatgcttttgtcaaaacaaatggctcatttaaatcatattctggaaggcttaccaaagcataaatctctccattttgcggattcattaaaataacagaaacccgttttgctttcttaaccttaagaactttctcggctgcctgctgtacataacattgcacattatagtcaacagaaagatacagatcattgccatttaccggctccacccgggtttctgccgcattttcaatctcgattccctgataatctgtaagggtcaaaatctttccatctgttcccttcagcacatcatcataacgggattctattcctaaaattccctgattatctgcaccggcaaaccctaatacttttgatgccaatgttccaaacggatagtatcttttataatcttcatctacctttactccgtcaagaccagcttcccttatctcatctgccacactctttggcacattactctttattttttctctcgaagataccttttctaccttcttttttacttcctcttccgaaagagcaagcttttgcgacagtagttttattaccttttgtgattcttttatctgataatagatcacagaaacggaacaaactgcctgattgtctgccagcacaataccatttctgtcatagattttccctctggcagccttgatcgtcctctccctctgttcgatatttaatgcttttttgcttaattcttcggaacgaaaaatcataagatagcacagtcttcctgcaagcagagtaaatcctaaaataaatgctccaaatacaagggtatacttctctttttgaaatgtatgaacctttatcgctctcaccctgcaaaatgttttaatagaagtatacgcagaaattctggtcttattactaacatgccatcatgatttttcaaacacgctctaaattcgctgttactgattcgctgcatccttcgtattctttttactttttgtcgtgctgctgcttgtgttctttttattttttgtcgtattgctgctggcttctgttgtagcactggtcgtatcgtccttctgttcagtgctggcattatctgtattagatgtatctgttgtttccggctttatgcccagcacatccacgatttcttccatgcaggctttttctaactctactgccagtccggcatttgcctggaatgaaacatttggctcatcaatcgttacatagattaagagctgcgggctttctactggggtaaatccaataaaggaaatataataatcctttttatttcttggaattttttcggcagtacccgttttaccaccaatactatagccttcaatctgtgcttttgttcctgttccagactccactgtctgctgcatataagaacggattgtcgctgaagtttcttcggaaatggtctttcttaacacttctttcccgatatcttttactacagccccattatcactctgaatctgctttacaatatgcggacgataataattgccgccattaataagagaacaaaatcctgctgccatctgcatcatcgtacagttaaagttctgaccaaaagcattcgttgctaaagttacactattggaataattcgatgcattgtatacaagactctttgtatctgtctcacctggaaggtcgattccagtgcttcgtccaaatccgaaaatattctgatatttataaaaagtatctgcgccttctttaaatccaatgttcatcattgctacattacaagattttgccaccgcatcttttaatgtaatgtttccatggacatgggaacatccgatgttacgctttcctaccataagagaacctgtacaaaaataattctcattgccagtaagtgctccactctcaagtcctgttgccacggtaaatggcttataggtagatcccggttcatttgtatcacttataatggagtttctccataattcattaaacgcatcatagattgttttctggtcatctgttttcttttttgtgctatcttgggaatcctcagaagcatcttcactatccgtagtttcctcagcctgcttctgctttgtgtaagctttcatcttatcaatatcactttgagaataaagagataaaagacttttctcatccatcggcttattcagattatatggataagaacttgtcattccgagaatttctccattctgcggattcatgacaagaatattcgtaaccttacttccaatcttatcatcaaaatcttttaacttctgctcaataatcttctgaatctgcatatcaatcgtgctgacaacagaatttccattcttaggttcttttacagactgctcctggtcaagctcctcattaaaataatagtatgcacgaccgttcactccgtttaactgactattataatattgttcgattccccagttaccaacattacctgaagatgtatacccaagaacacggcaggcaagggaattatacggataaactctcttatagtcttcctcaaaagaaactccctttaccatcttggcactttctatctttgctttctttgcttttgagactcctttcatagaagcatccgctaagtctaagaacttctgaaacttctccacttcgtcatatgtcatattctttttatatacttcataataagagtatggattatcctcaatcgtcttctttaatttactcttactaaatccaaaatactcatgaagcgcattaatggtcgcttcttcatattttttatcttgaagcaaaatattctgcggttccagtatgagtgtataaatcttctcattggtagccaggatatttccattcctgtcataaatcttgcctctctcaaacggcagaattgtactgtcatgtttttgctgacttagaactgctgtctcatattcttttccctttgttgctgtcacatagcataatttcaccaccaaaatcaaaaagaggaagatgatacctccaaataccaatatcagcttccctttcattggggtggtaagtcgtctgtctgcttttttcttcttcgccactttactaccacctgttctttatctgctttaatctacactttcatattgccggaaataatcgtcagaatccctctgatacaaaaggacatcggaatccttcggataaatcatatgtaacttcttctcggcataatctttaatctgatccagattgattgatttatcaatttcagcctgaatcgcactctgtttactttctaaacttgtcttttcagttttaaggtcagaaatctgtttctccatcacattaagctgtgcattcgcatgaagataaaacattgctgctgcagaacatatgattaccgcaatcaatgctaccagcgtatacttccagtcaaatgcaagaaacttcgccgcattcttctgaatagctgccgctgcttctgaatctgctgctttattccccgttcttctttgttcgggtcttctcacattcttctttgcaggaactgcctttgctgtctgcttccctgccatatctgtttctaactttctgacgttgcttccataaatgtattcataacgttctgatgtattacgaagtgccatattctacctccaacacgataaaatgtctctatccttctgtgattctcctctcaaaaacacgaagctttgcactcttagaccgactgttctcctcaagctcttccttaccaggcacaattggtttccttgtgataacctttccctttgatactctgccacatacacaaaccggaaattccggcgggcaaatacatggccgctcactggtacggaaaatattctttacgattctgtcttctaaagaatggaatgtaataatcgcgattctcccctcatcattaagaagatcaatcatgtcctctaaattattcttcagcacatcaagctcatgatttaactcaatacggattgcctgaaaagtcttcttcgcaggatgtcctcctgtagcgcgcacctttttagggatggctgccttgataacctcaatcagctgacctgttgtctcaatcggagtcttctgtcttgcctggacaatatgctttgcgatattctttgcaaacttgtcctccccgtaattacggataatatgatacagctccatctcgctataatcattcacgatatctttcgcagtctttgtctgtctctgatccatacgcatatcaagaggtacatcttcccggtaagtaaagcctctctcagcattatcaagctgataagaggatactcctaaatcaagcaggattccatctaccttggggattcccaaatctctcagtacttccttcatctgtgcataattgcttcttacaatcgttactttatccttatacggtttcagacgctttgtcgcagcttcgattgcttcgccatcctgatcgataccaataagccttccgtcctctcctaatcgtttcacaatttcagaagaatgacctgcacctcctaaagtgccatctacataaattccgttcggtttaattgccagagactcaattacttcctccagcataatcgatttatgaacaaattccatttttacctccgtgttccatttaaattttattttatatcaataagccatctaatgcaatataaacctgctgttattttcaatgttttatctgcaaatttccagagcgtgtttttcaaacacgctctaaagaaaaagaacgattgtccacaaaaaacaaccgttcccctttttctgttatttcatcctataacaaatctttttattatagatttattgttcttttattataaaatttctctctggtttgactctaaaccattacgaactcacctgttactgatttgttgctcgccacctgcagatgtggagtcatctcacatctgatatacattatctcataaaatccgtataaaccggcaatacaatctccggcttatcgtacattacgatttccccatcatgcatccagataatctgatcacataaatcctctaaagtagacatactgtgcgatacgataactacggtacggtctctcttagaaatgagctctttcatcttgttgtagctcttcttcttaaacttctggtcacctacactaagtacctcatcaatgagcataatctctgtctcaagaatcgctgtgatagagaatgcaagcttagaatacataccactagaatatgtctttaccggcatatcaatgaagttaccgattccggcaaattcaataatctccggcatcttctcaataataaactctcttgagaatccaaggagcataccagataaaatgatattctctcttccggaaagttcattcttaaatcctacaccgatagaaagtaatgaaatcgtatgtccatgaagatcaatctctccactatccgcagagaaaattcctgcgattgcacgaagcatcgtagactttccacttccgttctttccggtaattccaagaatctgcccttccggaacctcaaaagatacattccttactgcgtggaaaacttcctgttctaccttttttaatttgaaaaagttctgtttaatcgagcctgtttttaaacttttataatcaatgcagacattccttacactgattgcactgtttttattctcttccattaaatcacctttacatagctgttttcgttcttataaatcttacgaactcctaatgcagcaacaataatacctatgataaaccatatgataagccactttacatctggtgcctgcccgtataaaatacactttctgagactgctcaaaacaagagccatcggattccctttcataagaatccctgtgtactgtgccggaagtctcttctcaatattatagaaaatacctgtcatatagaataccatacgaagaacaatgttcgttacgttcgctaaatcctgaataaatacaccataatgcatcaaatgagtcatacatgcaaatgtaacaacaaagagtacaataaatgatgggataacatataaaatattcagcgtgatcggtattctaaagtaaataatcataatgacgataataccaaaagaaaacaacatcttatatccattaaaaaacatcttagatatgagcaaaataaattttggtatatataccttagttacaatagacttattattctttaaaagctttacactctgtgtcagacatcggttaaaaaaatcccaggcagtaataccgataaaaataaatgccgggaaatactgttctcttgcttcaaacacaacaccaaaaataaatgcataaatcagcatgaaacagaatggctctaatacccaccatatccagttcagataagagttggcaacttctgacttcagctctgactttgcagaataaatggcgtagcgatagtgacttgttaaatctctccaaaatcgcttcataacatcctccagccaatttggaactatccaaaatcattgtagtctcgcaacatatatattgccaatgcattctgaatagttactatattttttgtaaaaacctatggaattatagcataaacaggcgactttagcaagccttaccctttttatgcctgatgcgccctaaaatcatgcccaaaagtcctccggcaaaaatacagatacatactacctgggtcacagcaattcctgtgtgtccaatgataagctggtcaacccggagtccctcaataaagaatcggcctgccccatatcccatcagataaatacacaatagctctccatcaaacttcttatgttttcgatacaggaaaatgcacaataatatgagaagattccacaatccctcataaaggaatgtcgggtgcacctgaatatacgaaagcttctctccatttactgtcaacgtcacaagatgatcaagaattcctgatgtctttagttcagatactcttccatactgttcaaaatactttaatggaatctgcatggcaagtgggccattcgtatagcctccaaaagcttctctgttaaagaagttcccccatcgtcccataatctgacccagcagaagtcccattgtcattgtatcaagcattaaaagtgcactctgctttcttacctttgcaaaaattaacagaacgataattgccattgtcacacctccgacaatgccaagccctccatgtcttaaattaaaaatctcgaggatgttatccttatatgcatcccatgaaaatacaacgtagtaaattcttgcaccaataatcgccggaatcatcatccacagcagataatccatataaatctctggattctgcccagttcgctttgcctcctgctgtgcaaccaccagccctgctaaaaaaccgcaggcaatgataatcccgtaaaacataatctgaaagtttccgatggaaatgtatcttcctacatgggaaaggacaattcctaaatgcggaaaccgaatgtctgtatactgcataaagtcctcctgtttgataatgtctttttattatatccctcggaggggaaatttcaatctaattaaatgaaggttgaaaaacagacgctcatgaagcaagcctatcccctatatttgcgactttagtcgcggcggtttaaatgctcgctctactcgctcgcatctaaaccttgctccgaggccacaaatataggggataggcttgcttcacgagctgtctttggctgaatttggtttggattaatattttgtatgatcggtcttatgtggattcatttaaaacgaaaaagaattaatttacttgaatcaaataagagttatagaaattttataacttttccgtgttacctctaattaaaaaatctcgctttactgcaggtatatcgaagcaaatagaagctatcatcttctgtcctcaaatctcctcccactgtttcattcatcttactgccatagcacagaaaccattgaagccaataagccatatttgtggtctcggagcgagtattcagcacgccgcgactaaaatcacaaatatggcttattggcttcaatggtttcgtctgttttactactaaaccaaattatacattaaatttaaacagaaccacatctccgtcctgcatgacgtattcttttccctcagagcgtacaagtcccttatctcttgcggcagtcatgcttccgtttgcgattaagtcctcgtagctgataacatcagctttgataaagcctcgttcgaagtcagagtgaatctttccggcagcttgtggagcctttgttccacgggtgattgtccatgctttagactcgattggacctgctgtaagataagagataagtccgagtaaggaatagcttgccttgataagtttttcaagaccggattcttttaatcctaagtcctctaagaacattgccttttcatcatcatcaagttcagcgatttcctgctcaatctgcgcgcatacaacaaatacttctgcttcgcaactctttgcatattctcttactttctgtacataatcattttctgcaccgtcatctgctaagtcatcttcggaaacgttagcggcaaaaataactggctttgcagtaagaagattacattcgtttaataatgcctgctcatcctcatcttctgttacgaaagttttagcaagctgtccatcttcaagatgtgcttttactttctttaagaattctacttctgcagcaatctttttatcattgtgtgctgcgcgggcagatttggaaatacggcggtctaatacttcgatatcagagaaaataagctcaaagttaattgtctcaatatcacgaagtggatcaacacttccgtcaacatggattacattggtatcctcaaaacagcgtacaacgtgaacgatagcgtctacttcacggatattggcaaggaactggttaccaagtccctctcctttggacgcaccttttacaagacctgcaatatcaacaaattcgatagtagccggaacaatctttgcagaatcatacatatctgacagcaccttaagacgctgatctggaacggcaacaataccgatgttagggtctatagtacagaatggataattggctgactctgctcctgcctttgtcaaagagttaaataatgtactctttccgacattaggaaggccaacgatacctaatttcataaaaaattcctcctgtggtatttaagttcataatttcaatctaatattttagcatagaacctaaaaaaaaaacaggggttctgggttaatttattagctaggtagacgaaaatggaaagataatgacttgctatttgtgactttagtcgctgcaggttgaatgttcgcttgcccgctcgcatccaacctttgctccgaggccacaaatagcaagtcattatctttccattttctgtctttggctagccaagatgaattaaacccagaatcttgaaaggatttggggatgaatgccgtgagcagaaatgattttaatgcatctcatcttaattcaacaattcaactaactccagccaaagacagcccacttctttcttcgagggcgtctgttacttaacgaattaaaatcttgcccttaaaaccagcacctttcacctgttgttttacttttttgttttttacatatattttgcaggtttttggaatactttttaaattgcatttttttaagcttgttgcattgatgtatacttttttcagataacaatttttctttccaccgaaagttccacgtatcgtctggattttttttggaagcttaacagttgttaattttttgcatttgttaaatatagcgtagtctaattctttgatggaattgctgaaacgaatagattgaagattcttcatgtcaccaaatgcttcatctccgattttttttacggaatctggaagataaatgcttttaatattgtcgttcttataaaaagcaccatcatcaattacttttacagatttttttactttatagtttgcctttgtgcttgcaacactgtaaagtgttttaccatttttagaatagatatcgttgttgattacctttaaataaggattggaagaagaaatcgtaatctttacttttggacattttcttactgtaggccagtattttacttttttcgggatgtaaagactttgaagctgtgggcagtcatagaattctgttccagatacaccagctggttcttcaaacacaatttttttcagcttctggtaatgacaggctggttcagaaacacgaacaccttttgcgatagtaatcttctctaatactgcctgataagaacctgctgccggtttataagagcgatttgtttcctctttccaatcctgatcccagtcatcccagctaaagaaagttactttataagtatctccctgatactttaccttatttggaatgcggacttcgctttttccttttttcacattcaggcttgcctcacattctcctgtaattctgtttatctcgtagttaactccgttgatttctacccattttgattttgcttctacctttgaaaaagggagggctgatacagcaagtactgctgataacatcagggcagataatgttttaaattgttttctcattataacattcctcctgtagatatattaaaaccccaccattatagcacagttttctatttaattcactaggaaaactacagacgaagccattgcccccaataaggcatatttgtgattttagtcgcggcggtttgaatgttcgctcatgcgctcgcatccaaaccttgctccgagaccacaaatatgccttattgggggcaatggcttcgtctgtagtttgcttaatgaattaaatagcaatcaatcccttgtgattagaactaagagatagccttttttgacgcgaagtgttgcttctttcgccataatctcattgcttacccccacgctttctttgttgtacagtgtgccatttttcagtgagtaggagaatccttcttcgtctattcctgttacttctggggaaaaagcaattatggagaagtattcttttccaggattttgtggatttttgatatcggaacggagatattttcgttcttcggggccgtgaagcatttcgatttcattgtgtgcatcaacaattttggcttcgattccattatctttcaggaatgcgagcaggctgatatttgctaatgcatggtcatatctcgttccggttgcgccgagaattgttactttctgaggttttaaatctactgcgtattttactgcaagatgggtgtctgtgtaatcttttcttgttgggaattcacgaagagggatacctttttttctatattcttcaagaagttccttatttttaaggctgtcgaaatcaccgagaatgtcggttggttctatgccgatttctttacagtgtgccagtccggaatcggcagcgatgattcggtcatattttttatcttttatatattctttactaaagtttatatcaatacttcccccactgacgattaataatgtctttccgttttgcatggtatatttcattcccttctgatattatatttcactttttatatctaactgcatctaatcaaagcaatctatcttatttgttcttctaatcttttggcaattcatctcccaccttagaggtcggagtcttcttgctgtaagaggataaataacttactttctcaaaagatttttctaccatgaagaaaaacaagtttcatcagtcattaccatttcttttgctgtgctaattcttcataaaacatacagtaatcatcatagcggagtttgctgattttaccttcttctaaggctttttttacttcacatcctggttcatggatatgacagcatccattaaagcggcaggtattttcgtaaggttcaaattctgggaaataatatttcaggtcttctttttcgatattttcgagaaagagggagctaaatcctggtgtgtccatcaagtaggtatcctctccaatgtgaattaattcggaatgtcttgttgtgtgttttccccgcttgattttttcactgactgcaccggtttccatctgtttttctttactaatacagtttaaagtagaagatttcccgacaccagacggacctgccataattgttgtcctgccacgaaggagttcttctatctgtgtaatcccttctcctgttgctgctgcctggaaaatcacctgacatccactgttttcataatctttttcaagctgttgcatttgctctgttgttgctaagtctgtcttattaaagcagataattaccggtatttcctgctgttccattgtgatcagaaatcgattcagcaagtgaaagttaggttcgggttcatgaactgcaaatataacaagcgcctggtctacatttgctgccatcggacggatgagctgattttttcttttgtgaatcttcactagatttcctgttttttcttcttctgataaaatatcaatatccacaacgtctccgacattcggtttcattttcttgttacgaaagattcctctggcacgacactcatacagtccgctgccctctacatatacatagtaaaatcctccgattcctttcattatttttcctgtcattctttcctccgtaaaagtagtacatattgaaacaaaagcgtcggcagtaacagccaatcagccgttactgcgacgctctcccttaatctgaaatagcatttaaacttacatcgtaagtattatactcttttccatcaatatacataatcacgcttcctgagccttctctgtcgccctcaaatgtaacatttaaaggaaaatcatcattgcttacactgctctttgaataaatcgtgctttcccaggagtcctgtttgagcacaagttttacacttccgtttgctccgtcatcaaatggctgttcatcaattgtcacgctgccttcgtagcggtaactttcctgctcaccaagactgagcacaatcggtactttagtacctttgtctacagatgttcctgactcgattccctgggaaatgacatcgccttcgccaacttcaccactgtaatcgtagctgacagaaccaagctttaatcccactctgtttagctctctttcggcaacactctgagaaactccaattaaggatggcactgttgtcttgctcacgcctttgctgatagtaattgttactgcaaatcctgtgtttacgatacttccgccttttggactctgcttaatcacatagccttctttgaccgtatcgctattagcatatgctttcttcaccttaaggccaagcttctttaactcctgctctgctttcttttctgtataattcaccaaagccggtacttccaccttttctgctgcagtagtggaagattcctttttgccaagcgtaagcttcactttcgttccaacggcgagagattctccttttttatactgctgcttcacaacaataagatcgctgtcatcgctgctgcttcccttttcatatgcaaagtctgccttcaaaccaattgccttcatctcatcctctgctgcattcttcgtcagatcaagtaattttggcatcttaacatattctgtctttttctcttccgttgtcgttgcttttgttctgtcctgcgttgtctgttctgtactctgctgtgttgttccagaagatggctggaataaatgcaatgaatttcctataaaataaaatacaacacaggcaactaaaacaccaaacagaaccgtaattaaaagaatcatcttttcgagctttggattcatttctttatcgtctttataatcctcatcctcttcattttcttcattaattcgtattctgtcttttgtgttatcctcttttcttcggttgccagacttatttaatgactttcttatctttgtaatatcctctttatttctctgaattgttggagaatcatctacgagcggattcacatacacataacttccatctggagaaagaaatactttctgtaaatcaagaatcagttctgccgcactctgataacgctgttctggctgtttcatcgtacattttaagataatcttttcaagacttgccggaatatccgggaaataacatcttggtggtgtaatttcatctcttaaatgcatgagtgcgattgctactgtattctctccatcaaacggaacctttccagttgccatctcataaatagtaattcccagagaataaatatcgcttctttcgtctgcgtagccgccccttgcctgctccggcgaaaggtagcgcacagatcccatcgcactggaagaaatcgtatcatccccagttgctgctctggcaattccaaaatctgtcacttttatcgtaccactatctgataccaaaatattctgcggcttaatatctctgtgaataatgtgatgttcatgcgctgcctgcaatccgcttgcaatctgaattgcaaagtctacagtctctctggcactgagtcttccgtaacgtctgatatatcgtttgagagtcatgccttctgcaagttccattacgatataatgtacaccctcttcatttcccgcatcataaatatttacgatattcgggtgtgttaatcctgcggttgactgtgcttctactgtaaactttcttacaaagctctcattatcacaatattcccggcgcagaacctttattgctacataacggtttaacttatggcatctggctttatatacatctgccattcctcctgagccaatatgctcgagtatctcatatcttccacctaaaaaagtacccttttgcagcaatatcttcacctcccatttctattctgggcgatgacaactgcgatattatcaaggccgccataaaacaaagcttcttctatacatttttctgccagttcttcctctgttccttcccctgataaaatctcttccagtttttcatcgtctaccatgttagacaaaccgtcggagcagagcaaaatccggctattctccttcatatctacgataaagaaatccggctggacatcttctgccactcccacggcctttgtaataatattcttttgtggatgattccggctttctgcccggtcaagttctcctgcccgtaccagttcttctacaagagaatgatccatcgtcacctgatgaatcttttcatcaaaatagtacagacggctatcccctatattcataatatatgctgtcccatctactacggttgccgcaacaaatgttgttcccattccagaatactgttcttctttacaagacagcgtatacacttcctcattcacttcattgagaagccgttccataacaaggaaaggaagctcttttgtctctttccttgccagctccacaaatcggtttactgcataggatgacgctttatctccagctttatgtccacccattccgtccgctacaatatagaggttcggaaagcatcctaccggctcatcggaaaaaaacaaatagtcctgatttacttttcgctttcttccgatgtccgtcatgccgaaagatttcattcgtccccactcctttctttatagctctttcttaactgtccgcaggctgcctggatatctcttcccatctcccggcgcacagttacctgaatatgttgtctctccaatatatgtttaaatgctgctacattattctgcgttgactgctcaaaatctctttccttaatcgggttaaccggaatcagattaatatgacagttcattccttttactctggaaatgagttcctgtgcgtgttcctttttatcattaaccccttttacgaggctgtattcaaatgtaattcttcttccagttgttctggtataatatctggcagcttccatcaattcatccatcgaatatttattggcgattggcataagctctcttcgcatcgtatcattcggtgaatgtaaggaaattgccaatgttacctgtggatttctgtctgcaaattcataaatctttggcacaattccacaagtagatacggtaatatttctgtgactgatatttaagccatctggcgaacaaagtaattcaatcatccggcataaagactcaaagttatcaaaaggttctcctgttcccataacaaccagatgggaaactctctctcctgttgccttctgaatcgcataaatctgatcaagcatttcggatggatacagatttcttgaaagtcccagcaaggtagatgcacaaaaccggcagcccatccggcagcccgcctgtgaagaaatacagacagaattaccatgcttatacttcataagtacgctctctaccatgttaccatcgtggagcgaaaataaaaacttctgtgtgccgtctatcttcgactcgtaatgttctacttcttctactccatagaatggatgctcttttaaaagcttttcaatacatttggctggaacattcttcatctcttccggacttcttacgagtttttgatgaagccatccataaatctgctttgcccggaactttttctcaccaagttccatgacacaatcggtcagttcctctaatgtcatggactttaaatccatactagaatccatactacttcgcctccggtcttttaaatttagaaataaagaagccgtcgcaggtatcttctcccggtatgagctgtaaatatccctgacttcctgttcggtttttaagattctgtggcagatactcctcgatagataccagatgtaatggtgtattttcctcaatccactttatgttctctgcattctcccctttattcaaagtacaggtagaaaatatcatctggccgcccggctttacatacttccatacgacagaaagtatctgcctttgcaaagcggcaagttcgccaagctgttcctctgtcatctggtatttaatatcgttctttctgcccataatgccaagtccgctgcaaggcaggtctgcaagaagcacatctacactttctaacagactttcatcttcctctaacgcatcccattgctgcacctctacattctcgtagtgcatccggtctttattctcctcaatgagttctgttttatattctgtcaaatctctggaaaggacctttcctgctccctttaatctgtccgccgcatggaatgtctttccacccggcgctgcacagacatcaagaacaaaatcgccctcatttatatctgcgattgctactgcaagctgggaactctcatcctgtacagcaaactttccctggcggaaagcggcaatctttccaagataattgagattagaaatggtaaaggcatacgggagataattccctttttctacttttactcctgcctcttccaattctttttccagttcttccggtgttgtcttgcttaaattggtacggattgtgagcggtcttgcctccaggaaagaagcaaaaatcttctctgcactttccttcccatactgttctatgatgagcttactcagccattcgggtacggaatagataatacttacatactttacatcgtcttttttatctggaaccggaaggttttccttttctcttacaagagtgcggagcactccatttacaaagccgctcagtctgccaaatcctcttttctttgcaagagataccgcctccgaacaggctgccgcatctcttacatccataaagagaatctgataagctcccattcgcagaagagaacggatgagtggcttacatttcttcatcggtgtttttgaatagtggtctagaatataatcgagataaatctttctctcggtcactccctcacaaagtctggtataaaaagccctgtctgcctttttttcaaactggttccgcatcagtgtctccccgattgcgatgtgggaaagctttttatttctttcaatatcaatcagcgtatcaagagcctctgccctcatatctgtccgcttctccatctgcatttcctttcttcgtgtctgttttgttctgctacaattcatgcaataaatgcaacctactagatatattataactcaatattacaaaataatttttaatattgtattaagcattctctcccagaagagtaccttcctctaccttatgtccaagaagaaaagctttaaccggcattctctttttaccctgaatctgtacttcattgattttaagaagtccctctcctgtctgtacataaatagcatcggaagtcacttttgcaacagctcccggctgtgcgcttccattttccttctccacatcagcatcccagattttcaaagttttatcgtggaaagcggtataggcacttggccaggagttaagcccgcggatcagacgttcaattgaagcggcatctttattccagtcaatcttacctaaatcttttgtaagcatctttgcatagcagctctcctcatcattttgccgagtgcgtactgcagttcctgcttctaacttatcaagtacttctaataataacgggccgcctgccgctgctaacttatcatgaagtgactctcctgtttcttttgtatcaatcggtacaacaactttgtcaatcatatctccggtatcaagccctttttccatgtacatgattgttacacccgtttctttttccccatcaatgatggaccactgaatcggggcagctccacggtactttggaagtaaggaagcatgtacgttaatacatccatactttggcatatttaaaatgctttctgggagaatctgtccaaaagcagctacaacgataacttcaggattgagtccgcgaagaatctcgataaattcttcttctcctacctttactggctgataaacaggaatgtcatactctaaagccttctcttttaccggagtaaatgccatcgccttaccgcgaccttttctcttatccggctgtgttactacaccgacaacttcatggttctctataagagctgctaacgtagggaccgcaaagtccggtgttcccataaatactactcgcattcttcttcctccacatcatgatatggctcattcgctctctcgccgtaaagcacaccgtcaagatggtctatctcatgttgtaatgctcttgcacgaagtccctctccctcgataattactggatttaactccatatcaaaagacttcacttttacataatcagctcttgttacgctggcacatttacccggaatgcttaagcatccttcctcatctgtctgctcaccagctgtttcaatgatttctggattgataaggatgataggatcttcgtccataacgtcaatgacacagattcttcttaaaattcctacctgtggtgctgcaagaccaacacctcttgcctcatacatagtatcaaacatatcctcaatcaacgtctcaatggatggtgtgattttctgtactggtttacatactttatttaaacatgggtcgccaataaagcggattttacgaattgccatttcttttcctcctggtattcctttatctttcttattttatcttttattctatctttttataatggttatacaaaaagctgtatctttaattataacattgcaaacgcctgccgtaaagtcacttagagcgtgtttgaaaaatgctttctagtaatgcgacagtgggtcaaaatcaaactgaatcgttattcctgcaaacattggatgcttctctaaaacaggctctaatcttctttttaaatccagtaatgtctctttatctttatgttttaagtaaagcacctgtctatacacatcttttaacttggaaaggcttgcctgtcctggtgctaaaatctgtacgggtacttcctgtcctacctggctttgctcaatcattttctcaatgcggagtctcgcaacgacggactgtgattcatctcctgactgtaccaggattacaagcatgtgtgcacacggtgggtatcccattaactgacggtaagtgtactcttccttaaaaaagttctcatacgaatgctccgctgctgttgtaattgaataatgctccggcgaataggtctggatgataacatcccctcttttgtctcctcttcctgcccttcctgctgcctgacagagaagctgaaatgttttctctccacttcggaaatcctgttcatgaagggataaatctgccgctagaatccctaccagcgttacattagcataatcatgcccctttacgatcatctgtgttcctaaaagaatatctgcctcacccttagaaaatgcggcaagcatctcctcatgggcatgctttcttcttgtcgtatccatatccatacggagcactctggctgtcggaaactctgcatggagtgccgcctctaccttttctgttccaagaccaaatgtggctacatgtgagcttttgcaaatcggacactgctttataaaagtttcttcataaccacagtaatggcagcgtagctttccattcctatggtaagtaagtgtcacatcacagtgtgggcacttgataacctgtccacaggcacgacaggaaacaaatcctgcaaaaccacgccgatttaaaaatagcataatctgttccttttttgccagacgttcttctatttttttgtgtaattccccgctgaaaatcgagcggtttccttttttaaattcttctctcaggtcaataatctgcgtagttggaagcatcgcatttcccgctcgctttttcagggtccacagtttatattctccacttaatgctctcgcatacgcttctactgacggggtggctgaacctaagacaacacttgccccgcaaagacctgcccggtaaactgccgtctctcttgcatgatatttcggagaagtatcactcttatacgctccgtcatgttcctcgtcaatgataatcagtccaagtctctccgtcggagcaaacagtgcggagcgtgccccgataatcacatcggcttctcctgcccttatccgctcacaggcatcggacttttctccctttgacattctcgaattaatgacagcaatccgctctccaaaccgttcataaaaacgtctcaccgtctgatacgttaacgaaatctctggaatcagtacaattacttgctttttctttgcaagtacctgttcaattagtgcaagatacacttctgtctttccacttcccgtcacaccgtaaaggagataagtcccccgctttccattgtcatagtctttctgaaagttgtctgcgaccgcctgctgttcttcattgagcggccatcctgtacttctctttgtaagctctgggaatggattcctgtacttaatccttgactctaactttacaatgccctgctctgcgagtcttcgtatctcttttagcggaaagttacagccttttactgcttcttccttcgtgattcttcccttttctattaacaggaaaagaaatcttgccctcgccacataatgcttctgctcccattcggcaagaagcttctgtgcagcttctatatctgcagaaagagtaataaatacttcttctttgggtttcatttttgcttttaccggaagcacagtgcgaagggcctgtatcatcgtggaaccatattgttcttttaagaaagaagcaaccttgataagttctgactccacagaaactccctctgtatttacccggagaatttctttaatcttactttcttcataatctgcttccgggcgaatcgcgacaacatagccctccgtctcccggtttcctcttccaaacggaacaaaaactctgctgcctggccgcacttctttccataaggaaagaggcaccctgtactggaataccctgtcgagtgcctcatgggaaatatcaatgattatatcagcatatcttgtattactgtctcccataatccttccttttctttaatatttgccatctaaaacatcctgaacgatttcttcttcgctcatatgatacttcttgccttcaatctcctgataggtctcatgtccttttccggcgagaacaacgatgtctcctggctgtgcatgatgcatagcgtaagagattgcctcatgacggtcaataatagaaatatattctccgtctgtcttcttcattccaattaaaatatcatcaatgattgcctgtggctcttcaaatcttgggttatcggaagtaataatcgtaaagtccgcaagctttccggatacctcacccatctcataacggcggagtttggaacggttaccaccacagccaaataaactgatcaatcttggtggatcataagctcgtaatgtatttaaaatgctctctaaggctacggcattatgtgcgtagtcaataattaatgtatagtcatatcctgtcggaacaatctgtactcttccctttacgctgaagtggcgaagtgccttgttcatctgctctacggtaacacccatatgaccggcaatactgatcgcacctaacgcattatgtacgttaaatgttcccggcacaccacaggaaatcttaccttcgcaggttccctttaaaccaaagtctacgccgaggaagtctctgtctcttgtcagttccacatcatacgctactaaatctgcgttttcatttaaaccaaatgtctcaatcgggcaggtcgcattctttgtaatctctgcaaaatgctcatcatcaatattcgcataaccatagcggcactggttaaataactttgccttgcaggaaaggtattctgcaaagtccttatgctcgttcggtccgatatggtctggagaaaggttcgtaaataagccgtaatcaaacataattccagcagttctgtcaagcttaaatccctgagaggacgcttccataacaacaacgtcacagtcttcctctgccatctttctgaaatagctgtggatgtcataagattccggtgttgtgttattcactgggatatgttcctgtccgatcacaacctcgattgttccaatcacaccaaccttatgtccagcctcctctaagagagacttcaccatataggttgttgttgtcttgccctttgttccggtaacagcgattgtggtaagttcctctgctggataaccaaaccatgcggcagaaatcaatgccatcgcatagcgggtgttgtctaccttaatgacagtcacactgtccggtacctctacttcatcctctacgactaaaacagcggctcccttttcagcagcctctgctgcaaacttatgtccatcaaaagctgctcccttaatacataagaaaaggcatccttcttctatctttcttgaatcgttcactaccgcagtaacctttacatcggtacttccctgtaaacatgtatattctaaatgttctaataactgactacacttcattccaattcctcccttcaatcgcagaattctatgttttttattgtatctgttttctaaaaaagcgtcaacttttactctttttagaaatttcctgtctttttcgttctcttttttgttctcgcagatgaaaaattccccagaacagcaacgcaccgaaaaatgtgccggtactgtccacacagacatcaaagaacttgcagcttcttcctggcacaaagtactgatgaaactcatcactgcaggcatataaggcgcaaaagatttctgcccttatgatgaaattccagatggatagctccatcttttgttcagtgttttctactgtctgtctggcaatttctgtttcctgtgttgctgattcctgtgctgtaactttctctttgatatttcttatttccggcagtacattctcctgtactacagctttctgttttacagttttttgtaatttttcctctgtccgttgtatatcttttgcttttttctttctgctcaaaagcatctccattcgataacacatccacaaatagagattcaccgtaataccaagcactgcatattctgtaaaatgcgcgcattttcttatcggatactcgattgcttctgccactttcaccagcttctcttttggaaactgttctggaaaaaccgagtttaattcacggactaatcggatacataccccctcgcttaaatgtgaggaatgtgtggcatccgcggcagaaaaccgaaaaatcacacacagcatagtaattaccagtaccactgataaaatgtatgctactctttgtctggcatctgccctggcaaaagcctccctctttacataaaaaggcagaccccgcatactggtgtctgcctccctcttactccacatttgtaaatgccggatcaacttctcctaattcttcaaactcttcactggaaagatgttcttcatcttccatattctcttcatctcctggaagaatcttaatcttagaatcgtataattccttaacggcgatggataaaggcttctctccttccattccattaactaaaggttcatctcctccaataatctctcttgctctcttagaagttgcaataacgatggaataacggctgttgataactggttcttctcctgtctcgccctctttattaatcttttccattaattctgtataagatggatgtaacataagtgattctcctttctatttgtcctttttaaggttctatttgtctttttctgtattttctttatattgctgcaaaccttctcgaaggctttctacaaactcctgtctctttgtaatacgacaggactcactctcgatgattgaatgaatcgtattcatgcaatcttcaagctttccttcttcattgctgacaatgaattcatactgatcaatgctttctgcttcttctgcagctcttcgcatacgcttttctactacttccgcggtctctgttccacgtccgataagcctgttcttaagtacatcaatagatggtgcagtaataaataacagaatcgcttctggatactgctctttaatcttcatcgcaccctgtacttcaatctcaaggattacgacatgacctgcggcaagttcatcttccacaaacttacgtggagttccataataatggtctacatactgtgcatattcgataaaaccattataatcaatcagacgcaaaaagtcatcttctgatttaaaatagtactctcttccgtcctgttcgccttctcttggctgacgggtggtcgctgaaacagaaaggctgtagccaaacttttcaacgagagcctttgaaacagttcccttgcctgcaccggaaaatccggaaattacaactaatgttcccttatctttcattttcctcatcctcatcattgcgtttgctatggcatctcgaagataatgtatctgtcgtgagggcagataaaataagatgtccgctttccatgacaagtactgctcttgtacgccgtccacaggtggcatcaactgccttaccctcgtctcttgcattctgaatcattcgcttgattggtgcagcgtctgtactgaccatggaaataatcttatctccattcaccatatttccaaaacctacattaataaaatctgccattttctctccgtctactctatattctgcacctgttctctgattttttcaatctctgtttttaaatcaattgcatgatcagagacttcaatgtcgttcgcctttgataaaatcgtgttagcttcccggttcatttcctgtgcaataaagtcaagtttacgtccaacattgccgccttttaaaagttcatctctcattccgtcaatgtggctctttaatcggaccgtctcctcgtccacgcagattttatcagaataaatgacaacttctgcggcgattcggttctcatctacattcgtatctcctaaaagttctgcaactttatcttcaagttttttgcggtattcgctgacaattgatggataacgctcctcaataaaagcaacattttccttcattccttctaacttggcaagaatatccgtcttaagattttcgccttctttttctctgctgtcagaaaagtgacctgctgcctctgagagagctttcataagctgttcctttatggattcctgattgactgccacatcttctaaagaaagtacgtcagggaatcttccaatctgtaaagctgtcacatcactggagattccaagtgtctctccaagctttgtgagggctgcataatattccttacctaattcttcattcaggcggacattcacatcctttgcagataaatcttcataatttatgaaaacatctaccttacctcgctggatagactgttttaaaaaacttcggatatctgcctctaaataattaagctttcttggaagcttcatattcagatcgcaatatctgtggtttactgccttaatctccacagttactttacagtcctctgacacgctctcgccacgtccgaatcctgtcatgctcttaatcacttttctctcacctcatatctaaaaacattgtcattcttaaaattttacaaagtcttattatatatgaaaaatgaaagttcgtcaatctagaagcgtgtctgaaaatgctccaggattctttttgtgttttatgatttatttcttatctgtatttctttcctttaaatcttcctgcatcgccacaagataatgaagggcaatacctcctgctgccgggacaaaaaacttcggggataattcttcatatttaaagttcttttgtccgcctgcttccatccgctcccagtactttatcatttctgaaaaccgcagataatagcatttttgccgatgggtataataaatgagcaaaaagctgattccattctgcttttcaaagttcttcatgaactctacctgatgtggatgaagattctgcagggaaaaggtatccactgcacattcctttgcatcaaaacaaactggaattccctgtaccgccccgatatagtcaacagtactttttttctcaaagtaagctaaggtaatatgacgagattccttgtcaaagcggacaggagttatcggtgtcggaatcttctggataagagctaagcctttgtctttgtacttttggtttgcgtaattgatcagttcttctaataccgaacctcgaagtcctcttgagttccaggtagccattttatttttcccttctgctctttcttattttctctgttcgtgcattttcagttttcttattagttgtccttcctgttcgtgtattcccagctcttttattatcagtttctcggttcttagcctcgttctcataagaaagttcaggaacttccagtccccatcttgtctgcaccttatgaaaaacttctggtaccgggtcaatgatatgcaagccgaaaagttctcctgttccttctggaacaaccagttcataactatgcaagagctgataattcacaccatctttccacttgatctggttgttaaaatcacgatttccatatttgtaatcaccaaatactggatgtccgacagatgccagatgtcccctgatctgatggctctttcctgtgataagacggatttttaagaggcttgctttatcagtactttttaaaaccttatattctgtctcaatataagaagcaccttctgccttttctttatgaagggaaactttattatttttctcttcttttgtaagatagcctgcgatgcgggcatcttctttcactttcccttctacaagacaaagataatactttccaagtgtacgttctctcaacatagaggccagacgctgaagtcctttgatggaaattcccgcaagaacaattccacttgtatttcggtcaaggcggttggcaatagacggacggaagcctgcaagttcttcttttgaaatgattccagtctgaatacagtaatcaatcagataatcatttaaggaatcatcactggctttggctctttgagaaagcattccggcaggcttatggaatacaagaatatcttctgaagaataaagcacacgcacctgcttacgaagttctcgttcttctttcgtaagttttcgttcttgtcctccattgcccgctctgtctttcgtataaacttttgcctgttctctgtcaggctgtctattccgtcctgactgtccaaaccctctatcacttttatgattttccatactgctgtctgcctcataagaatcatctcttcctgattgcggattttgaaacttttctaaagtctcatctgagaaaaaaatctgaatcagatctcccgctgtaagcttctccctgccttctgcttttttcccgtttaacttaatgttctttttgcgaagcatcttgtgtaagaagccagaagatgcgccaggaagatactttataaggaacttatcaaaacgctgtccctcttctctttttgtaattgttatttccttcatcgtctctttatttccttccgataaattgcaggaaaaggctgtgcggcagtatctttgtcacaagatgcgtgagtttgattgcctttccatatatagaaatctccttattctgttcattatccttccatgcttttttaatcactttcttcgggtccgccataacaagtttcttataagctggcaaatgcttctttgtcagtgcacgattaaaaaattctgtctttactgctcccggacacaccgccgtcacccgaagctgtctttccctgttctctgcccgtaaagccctgacataacttagtacaaatgccttacttgccgcgtaaacagcaaatcctggctgtggaagaaatgctgctgcggaagccatataaatcatgcgtcctctgtatttcatatagggaagtagcaaagaggagatctccacaacacctctacagttcacatcgaccatctctgcctgttcttccatggaaatatcctgaatctttcccataattccaaagccggcacaatgaacaaataattcaatatgtggctgtgtctcttctaatgtctgtttcagacactctacatcttctttcttctgcaaatccagtggaagtatccgaaatttctgttctttataaaggctcggccatgcttctaagcgttcttttcgcctggcaattacccatatttcatctaaatcaagatgattttgcattgtgagtttcacaaattccttacccattcccgatgatgcaccggtgatgattcctatattcatctggattcctcctatccacgtttctatctgtacttcttccttgtatgaacgttacggattgttttcttctttgactttcctctctcttgcgtctttccggtaaatctgtctgtcttatatttctcgttcttttgtctccctgctttaaagtcttctggcctgtctttacctgtcttatatttatccgtcttaaattgcttcgacttcatattttgaggcttgcctgattttggctttgtatactttctggtatccgccctgccatctttagactttgctgtattgtccgcagatacctttttaccagggtgataattatgtcccatttttcttggcggaatcagacaatgctcatcaaaaccaatcaaatcttctcttcccgctttaatcagagctgcttttacaatatcataattttcgggatttcgatactgaattaatgctctctgcatctgtttttcctttaacgttaccggaacgtagacttctttcattgttcttgggtcaagtcccgtataatacatacaagtagaaatggttcccggtgtcggataaaagtcctgtacctgttctggcatatatccaagatctctgatatattctgccagcgcaatcgcctcttttaaatgggaacccggatgagaggacataagatacggaaccatatactgcttctttccaagctttttattcatgttcctgtacgcttttgcgaacttctcatacacctgattctccggtttgcccatcagttttaatacactgtcacaaatatgctctggagctacttttaactgtccgctgacatgatacttacaaagttcctctaagaaatgatcctttttatctgctaatacatagtcgaatcgaattccagaacggataaataccttttttacacccggcaatgcccgaagtcttcgcaaaagagtaatataatcactgtgatctgcattcatattcgcacaaggctttggaaaaagacactgcttattcgcacacacaccatactttaactgtttttcacatgcagtatgtctaaaatcagcagtagggccgccaacgtcatgaatatatcctttaaaatccggatcttttataatcagctccgcctcttttataatggattcctgactgcgcacctgaatccttcttccctgatgaaatgtcagcgcacagaaactgcatccgccaaaacatcccctgttacttgtgagagaaaacttaatttcctttaatgccggaacacctccaagcttatcataagatggatgccatgctctcatatagggaagttcatatacatgatccatttcctcttgcgtaagcggcaatgatggtggattctgtacaagatattccttctttttatacggttccaccagtctttttgccgtaatcgcatccgtattcacatactggcgataataacttttggcaaaagtctctttggactctgtaatctcttcataggacggcagaagttcataatcaccggaaagttcttctaaatccctacatttaaatacggttcctctgatataagtgatatcctgcaccgcaattccagaatctaaggcttccgcaatctcaagaatagaatgttctcccattccatacatgagtaaatctgccccagaatccaagagtacagaacgctttactttgtcgctccagtaatcataatgtgccagtcttcgaagagacgcttctattcctcctaaaagaatcggcgtctttttataggtctttcgtatcaggttactatatacaattgtcggacgattcggccgcccggaaaatcctccgcctggcgtgtaggcatcctggtgtctcctctttttaaaggatgtataatggttcaccatagaatccatgtttccggcagatacaataaatgccagtcttggctctccgcatacggcaatgctgctctcatcattccagtccggctgtgcgataaatgctactttatatccggcatcttctaacagcctggtaatgattgccgctccaaatgaggggtgatctacataggcatctccacaaatataaacaaagtctgcctgttcccagccacgctctttcatctcttttttattcataggtaaaaagccatgtttttttatcataaagttcttcctttcctgttccctgctgttcctttcccaaagccggtttgaaaaatgctttctgcaaattggggcgtgcagattgtagaaatttttcaaacacgctctaatcttctatatttcatcatctatttttattgcttatatctttttcttattgtttttattatttttgtcttatcattttgaagctgtactttcttttaattttgcaagttcctcctcaaaaagtggtctgtactccccttttttcagttctttatcaagtaccaatggccccatggaaattctctttaaatattctacttttcttcctactgcctctgccattctctttacctgatgaaaacggccttcctgcactgtaatgaaaacttcatttgccttgtccgttatttcaagttttgccggaagtgtctttttctcatctccaatatctaatccctgcaaaaaaagttcctgttctttttctcctacctctccgtcaagaatcgcaaaatatgttttatctacatgctttctcggtgagagcagattatgggccaacgctccatcgtttgtaagaagtagtaacccctccgtatctttatctagtcttccaacaggaaaaagtccctttcgtccctctgttatcaaatcaagaacggtctggcactgtgcatcttccgtagcactgacaactcctgccggtttatgaagcataatataacgatatttttcgtaagttaccacttccccatcaaggcaaattgcatcttcagatgaaaccttcatctctgcctttttcacaacttctccatcgacagtaacactgcctttttttatcttttgctttgcttcactcctggtaagctccgctgcctgtgtcagaaacttatccagtctcatcttttttagagtttccggcatcttacttgttcctttctaacttactttctagagcgtgtttgaaaaatactttttgcaaacatactctagctgttccagccattttatctacctttatctgttctatatcctgaatctctgtcttttgcacgattttacagtattcctgtaattataatttacgccagtttggattatatttattctttaatcggccacgattgcatttgccccagccaagtggaaattcatctacacaaaaaagtgtccatccattcagtccggcatcttctatatctactgtctccccgcggagatacttttccacgcagatgtcttctgctttaaatgaaacacttctcttatattcttctggcttaagtgccattgcaagcgcctggcttggttcaaaacgcttctttaaacaatctccaagataaagaccagaacggactactcgcagtcccttaaagtccgggcaattctctggcagtaaaaaggctctctcttttataaaaataattcgattcttccactgctcccattctggaatctcccgcataaattcgtccatcgcttcgggaatcttaacatttttaaccttagaaatattctgtgtctttccatctttgcacatcttttctttatcttttgtttctttatgcacagattttgatatgtcatcttcctttatacactgtttatccacagattccacaccatctgctttcctaaagagagcagcaaaatgtccctctccctttactttatgcggtaaaaagcggcgacagttcttcacatcttctctgccacgaatcgtccactctggttttccctcctcgataccatcacaaagaggtaattcctgcaaagagaaatctctatgttgctctaagaaatattccactgtctgctcgtcttcttccttcgcaaaggtacaagtcgaatataaaagataaccgcctggctttatcatctgcgctgcacttgtaagaatctctctttgcagcttagcatagcgttctacctcctctggtgaccagctctttaccatagaaggctcccgccgaaacattccctcaccagaacatggcgcatccactagtattttatcaaaataccccgcaaaacgccctgctaatttttccggtgattcacaggtaataacactattctttactcctgccatctccatatttttaaggagaggtttacatcgggaagcactgatatcgttcgataataaaaagccctctccctgaagcttcgctgctaatgcagtggacttccctcctggcgcagcacaaagatcaagtaccttatctcctggttctactggtaaaaaagcggcaggtgccatcgcactcggttcctgtaaataatacactcctgcataataatacggatgggcggataatttctgttcgccctcataataaaatcctgtactacaccaggaaacttgtccgtccaaaaggaaccggcggataaaatccgccggttccttttttaactgattcacccgaagcgtctgtccataactataattaaaactatccagatactgcaaatactcatctccgccaagcatcttttgcatcttgttctgataatcttctggtaaattcatccattcctcctgtatctatctgtggttctatctcactgtctatgttctatatggctattatctgcccccatacactgcactctcaccctacagactctgtgcgcgatatccttctgaaataatatcaagctgtcttgcaaagtgttttaactgtaacatatcatcaagtacatacaccttataaaactcatcctgaatcttcgttacttctctctgattcgccactttatataagttctggatattattcaaaatatccttgactaaggtctccttctttctgtgagaattctgcgcatccataatctcatctcttacatccgacatctcatggtccacttcgataatggcctccgatgcatcaagaagcttctgctgaatatactctggaatgttctccttatacttatactgtaaagaatgttctatcgtcgcccagaaattcatcgccatcgtgcgaatctgaatctccgcactcagctcctttggtccatgaatcgtattcaccgtatataaaatgatcatgtgataactacggtagccgctcgtcttcatgtggcttacatagtccttctcacactttaccttcatatctgtccggttctttataagattcaccactctgtctatgtcctctacaaactgacagataatacggattcccgccagatcttctatcttcttctcaatatcattcattgatacattcttacgctgcatcttatctaaaatactgacaatactcttcactcgtccgtccacggactcaatcggtgaatataaaccctgattccgatgttcttctataatatgatgaaactttacggttagctcatcaaccgcaagctggtatgggtcaagcagttctctccaaagctgtatctccatataatcacccccaaattattataccatttttttccattttgtgcaagtaaaaatgacttaggttaagaacatgtttgaaaaatgctttctgcaagatgtgttttacaatttgtgcttttcactttcttgctatattatataataatacaaatcaatccgccactgctttcgtttacgatcttttccatggcgttttgaagtttttcctggctgtcatcgttaatttttgtaactttgccagatatgccatcatcaacaagctgttctaatgtttttccaaaaatattgacattccatatttctcttggttcttcgcccgcctgttcttttatgtatgtaataagatcttctgcctgaagctgtgtccctacaatcggggccacttctgttgtaagattggctcgaatcaaatgaatggacggtgcctcggcacgaatttttacgccatatttgtttccatgttttactacttccggttcagaaagtgtaatttctgaaagtaccggtttcataacgccatatcctcgttctctggcatcctttaacgcctgcgacacttcttcaaattctctcttttttgccgataattctttcatcaggcgaataagatgatattcactcttaattggcagtcctgtaagatccgacaaaatatcataatagtacgaatcccttatctgaatcttaacatccacttttcctgtatccatatgaattttttctattttcccggactctatataatcattcgatggaaatactttctgatacagatctttcatcttatttttatccgtcataaattcttttacaagatctaagaccgacttcttcatccaatgatcatctcttaatgtttccacccatttcggcaaataaaatccaacagaagataatggaaattcaagcagtacattttttaagatttctaaaatatcctcctgcctgagctggtcacaattcaccgccattacactggtattatattctttagaaagcttttctgttaatgcctgtgttgcctttgaatatggccgttcactatttaccagaaccaaaaagggctttccgatttcatttaattctgcaactgttttcttttctgcttctacataagaatctcgcggaatttctccaaacgacccatctgctgtcactaaaatccctatcgtagaatgatctctgattacctttcttgtgccaaattctgctgctttcgtaaatggaacctcataatcaaaccacggcgtttttacaagacgttcctgtccgttttccaaattaccgcccgcaccgggaatcataaagccaacacagtcaatcagacgtatttttattttcatatcttccatcggaagttctgccgcttcttttggaataaacttcggctcggttgtcataaccattttccctgttccactttgcggaagttcatccatcgttctcttgcgttcattctcatcttttatttcaggaagtacaagaagttccataaaacgtttaataaatgttgatttgccacttcggacaggcccaacaacgccaagataaatctctccgcctgttctggctgaaatatcctgatatatattttgtttttccatgaaaatccctccccaatactaatttagtatatgcaagggaatagaaaaatagactattttgccttagtatacttgaaaaagattccatagcgtatttaaaaaatgatgtatcacatcgctgccagaatttactctgcaaaaaatgcggtcactaactgacacaaactaacataatccgccatagccatcgtctctctggctgaatgcatcgcaagcatcggtatgcccagatcacagcctgccatcggcagatgtgaaccaatcatcggacctaatgttgtgcctccgcgaatcgtgtttctgtcattaatctcctgtagtaatatatcatacttttcagataatccttttaaaatcgcatacattttgcagtcagaagcatatttctgtgtaccgctcaccttcacagtaactccctgccccatatatgctctcgttgtcatatcacaacggtctgtataattcggatgtgcggcatgtgcgccgtcaacagaaagataatagctctgtgcaagtgaaatatctatctgttcttttgaacagcccattcctgaaagaatacgttcaagaattcccggaagtaaggcagaatctgctcctgactttgtaaaacttccaacttcctcatgattaaaaagcccaataagattaatgccactttccctctctccatctgtaagagactctaacaacgcactgacagaggccagattatcaattcgcggactgcataaaatttcttctttcaccccacaaagctgtggctgatcatagttgtataaattaagatcataacttaaaatttcactctcatccacagaaagttcttctgccagaaaatgaagaaaagcatcttctgtccaccggccattggcaagccccataagcggcattaactctttttgccggtcaatcttccagccattatttgcctctctttgcatatgaatcgcaagtcccggaatcaacgcaaccggtctcttactatcatacgttacctctatcggattaaatacatcctctccttttagcacaatagttcccgccagtccaagtggacggtcaaaccaggtatgatccatcattccgccgtaaacttctacattaagcatcgcacaccccatgctcttaaaatctggttttcccttcaccttaaaacaaggctgatccacatgtgcaaatgccatacgcaaagactgaatcatttcttttccagcacctgttgtaaaggcaaataatacatctggaaatggggcaatataatatttgctattttcttttggtgaaatcattttattgtaatataactcttcaaatccctgttgttttaaatattccttagcaaaagaaacgactcccaccggggaagttccctgtgctaaacattctgttaaaacattcattctcaatctccttttcaaaaaaaataattcatgttatcatcaatcataagattttgtcttaatagctaaacttatggaggagttattcatgttatcaatacaaatttccgatattaaagactttatgtctcatcttttatccaaagatacattcgaccacttttactttatcgaagcctctatcaaaatgggggtaagttatcagattcaggggcgtattaacgaaggtttttatgataccagcgtagaacagacactgaatcgtgaattctgctattggaaagaaatccgccaccgcatttttgatattattaaagggaaacggctccctctctcctgcaaaatcgttctcggactttcaaagcaatccatttcctatttgattgcgcataataacagttccttccgcgaagaagatattgagggaatctacgtaaatatcttatatgacccgaaaaatcttcttatcacaactggaatttcctataaaaatttctctctcgataagtcgttagagtatgcttttgatgaatatctggcgaagtttttaaaggaaaaagcagttatatagtataataatctaaagcgtgtttgaaaaatactttctgcgagatgtgtaccacaatttgttagagatttcgcctgaatgatggtgcgtagcgggctacgtcaactgaatgaaggcaaaatatactgtaaattggggcatgccggctgcaggaataatttttcaaacacgctctatcaagaaaatcccattcttattttttcaaaatctctatcgccttcttcaactgtttatctgccttctcatctgtctgggcttttttccactgcttatcgctcattttcacttccacatccggctcgattcctttttcatgaatatctgtaccttttggtgtgtaatatttggcaatggtaaacttaaaggctgaaccatctgtaagaggcagaatagtttgtacaattccctttccataagttgttgtacctacaaccgttgcttttttgtaatcttttaagcatcctgtcataatctcggaagcgctcgctgtatttccgtttaccaatacaaccatcggtacatctactgttttacccgaatcactcttgaactcttcttttttcccctttttatcttttgtataaacaagcattttatcctttgcaaccagacgggacagcatattggtacaggtagttaacagtccgcctccatcatctcttaaatcaataatcagactcttcattccctggctttcaaggtctgttactgccttatcaaactgttcgtccgtattttcatggaactggcttactgcaatatagcctatcttattcttccgcattttataagtaacactatctaattctacagaagttttttctactgtataatcttttgtttttttatctctgtaaatagtcaaaacgactttatcattatcttcgcttctaatggcagaaacaacatcctgcagttccatatcggcagtacttttttgatcaattgccgtaatgagatctccattcttaatacctgctttatatgccggctgatctttaaatacagaaacgacctctggataattcgtatctgtgtcttttgcaatagaaattccaattccattatattttcccgcatcttcttccgacaattgctgatattctgatggggtataatattctgcataggggtcttgtaagcccttagcaaaccccttataaatattgttctccacattctcagcatctattttgttgagataatagttacccgcaaaagcttctaacatacttagtttgcgcaaaatcttcccattattaaggccggttccataagcatttgaagtcataacactttgtcttcctgcaaagaaactgaaaccgatgataacgacaagaacaagcacacttaaaacacgtttaaagcagcctttttttctttttgggctgccttcctctttcttttttttattatgttctgaatcctgttcctttaactcaagattcatttctttttccttaaaatccattctgtcttcctttctctcttcctatgaaaatgtgtctgcattactgactcttcgtttcgtttaaagaacaatattacttcttgccagagcgtgtttgagaaatgctttctgcaagatgtacatcacaatttgcgggagatttcgcctgaatgagggcggcgtagcgggctacggcaaccgaatgaaggcaaaatatatcgtaaattggggtgtgcagattgctggaatgatttttcaaacacgctctagagcgtgtttaaaaaatcaaaaacgccttctgacggtgtatatcttctccgacagaaggcgttcttattaatattcgatactttccatgtacttcatgtattttactaccatcagtgcaatcttaaaagtaatcgcatcttcaaatactctaagatcaagccctgtactcttctgaagcttatccagacgatatactaaagtatttcggtgaatgtagagctgtctggaagtctctgacacattcaggttattctcaaagaacttattaattgtctgtaaggtctcttcatcaaattcatctggagaacgtccgtcaaaaatctctttgatgaacatcttacaaagtggtaatggaagctgataaatcagacggccaataccaagtcggctgtatgcaatcacattcttatctggatagaaaatcttaccaacatccatcgccatcttcgcttctttataagaacgggatacctccttgatctcattcacaatagtaccaaaggcaacatgaacctttgtcatcgcttctgtgttaagcatatcaacgataacctgtgctgtcttagtcagttcatcgtatccctctccattcttcacttccttaacaagaataatgttcttctcgtctaccgcagtaataaaatctctcgttttcgcagaaaaaatattacgaactgtctcaaatgcattattatctctgtcattctttgtctcgacaataaatacacatcttcttacttccgtttcaatatggagctttttcgcccggttataaatatcaaccaaaagtaagttatctaagagcaggtttttaataaagttatctttgtcaaagcgctctttataggcaattaaaagattctgtacctggaaagcagccatctttccaaccatatatacgtcatctgtctcacccttaacgagaataatatactctaactggttctcatcaaatactttaaaaaactgatatccctgcaatgcctgactctctgccagagattctgcaaataccagtaccgcttccttatattcttcgactgcatctaatgtggaggcaagcggtttaccttccgtatccatgacacataagtcaattctcgtaatcgccttaatgccgtcaatggtgtcctgtaaaatctgatttgaaatcatcgtatcactcctgtctttccctctcatcgcattttgctatcgcacgcaacaatctttctttattttaatacaaaagtaacaaaaaaaaagaggaaatatgcaaaaaatatatttcctcttgtgaaaagttattattttttatatcaattcatgtggaaaagctacaaaaatttatgtacacctgtaaatctattccaaatcattactcaaacacactctagagcgtgtttgaaaaataaaagttgcacaaaacatatattcccacgccctttttcatgataaaataaagaaaaaaggggagtttattatgttgagacgatatgaattaacagatgaagaatggaatcaaattgtttctctactgccacctgaaaattctggcaaacaaggacgaccatccaagtgtaaccgtaccattcttaacggaattgtctggattgcccgcagtggagcaccttggcgtgaccttccagaacgctatggcccttggcaaactgtctattctcgctttcgcaagtggatggaagacggtatccttgataatatctttcgtgttttaagccttgatgcagaattaagcgaattatcaatagatgcctccattgtccaggctcatcaacatagtgcaggtgcaaaaaaagggggccatccaacgaaatcggacacagtcgcggtggagcaagtacaaaaatccatgccattgtagatgcttatggttatcctgtttatgttatgctcagtgagggacagcgtaatgatattaattacgccatccctttgctagaacaagttgacataaaggaaagtgatatactggctgaccgcggatatgatagcaataaattaatggactatatctatgcccatggtggtgagccaaccataccttccagaaaaggggctaaatttgaccgttactgtgactggcatctttacaaagaaagacatttagtggaaaactattttctcaagttaaaagcattccgtcgaatagccacgcgttatgataaattagcatccacttttgcagcatttatatgcatcgcctcaatattaatttggttaaaatgaacaacttaaaatgtttttcaaacacgctctagagcgtgtttgaaaatgctctagcatactgcctgtgctgccactccaagaaattcagaaacatacggcgttgccggattgtcataaagctctccgatcgtgccaatctgctgaatacttccatcattcatcacagcgatgcgtgcatctgtattctggatatcctcacgattatgtgttacataaattactgtgatatgcatctggtcataaagctttcttacaagcttctgcatatgtctcttcacatctttgctaagactggaaaatggttcatctaacagaaatacctttggctttttaaccatagcacgtccaagaactactaatgctctttcctgctcatctaaatcttcggtcatcttatcaagaagatgtccaatttttaaaacttctgtaacctctgcgattctcgcatcaatctctccctttggtaattcctttaatttaagaccgaatgcaagattatcataaatgttcatctgtggatataactttccgttcttgaaaatcatagccatgtttctgtcgatggatggaacttcattcatgcgctccccgtcaacgagcagctccccatctgtaatatcctccacaccagcaatcattcttaatactgtagaaatcccgcagcctactggtccggcaaatatcataaattctttatcatcaacttcaagggtaaagtccctgattgcattgaccccgttatcatatgttttgctaagatgtctaagtgataaactagccataaataacctcctaaaaataagttcatgctacaaacattttgtcctcatatatcatacctaaattttgtaaataattctagaagaaaactcacgaaaatagagccggtatttcggctatattgttaagcatattttatctattagacatatttaccattttcgatgcacaaaaaataaaaaacacacctaatattgtacatgtattaaagcaatttttaaaaaaagacacttttcaattttatttttgtgaaaaatgtcttctttttctttatattttgctacttttttaacaaatagctgttctattttactaatattgtcttcttttttctaaagtattaacattttcttcctgtacgtccaaaatattttcttccgaactgtcttctggtttctgttcagattcttcttctgaagcctcattcaaaacttttttcttgaaaacagacccgacaatggtgttcttaatcttttgttcctttttaaaccaggaataaattccttctaaatgaagcttctctacccaggatggaatctcctccgtttctttacggataagcggctgaactgactcaatcagaatacaaagacgtgtattcatcatagcggcatgcttctccataaacttcatctggcgctctgctggaatacatacaaaaacgatatccgggatgcacgcattaatttcatttacaatgcggtctgcctctcctttcgtctcctttcgcatgacattgccatgtacttcgatatttcggtaagactcctccatatattcttccatggattctaaataagattcctgttccatgaccatataaatacttcgcccttcccggtttatcttagaaaacagcctttttaaataattatcagcaaattctccaattccttctggtatctgtccattatcctgtctgtgatgtactgccatctcaatatggcggtctcctgctaatatgagattacaggacttcacatactcagctgactgctcattattttgacataacagcgaactgatggctgataaaaaatagattacaggaagtccctttccacgcatcaattccattgatacattgaccgccttgtccacccgcatcactgatacatctataccaagtacatttgcctttttgtggtaacgatctttcatgttaaggttcctttcttttctcttctaaatcgtcatgttgccatctattccttactgctcagagtcagaaccaaagtcatatccgccagaagttgtcgtgtcatcatcgtcccccacatctgtggaatctgtagaatctgtagaatcagattcatcatccagtgaagaatcggtaactgtctcatcttctgtatctgtggtactgtcgcttcccgccggaacattggtactgtctgttccgatataaatctgaatatctccacctgtagaaatagaatctacaacattaatctctgcatctgggaagtaagtaagaagatcctgtcccattccgtcctgtgtaacattaattcttgtctgtgaaagaggtccctcttcctgataggaatctacaaggctgatactgtaaccttcgctttctaaataggactcccactgtccagccagtccagaaacataggctgcattataaatctcaatagagtaatttttagaactttctgtacttcctgttgctgctgatgtactcgttgtaccagtagaactcttagaagaactactctggctataggcttcggcctgctttgcaagccctgctacctgcagcttcaccttctgagaatctaatgtaaatattccttttgactcgctaccctgcataatacgaattgtgagtgcatctgtagtaagattctttaaaatatcttctgtagaagtaagtccactcttgccctctgcagtcacaagactatcatacttcttcgcaatcgcagaagtactattcttagaaagaagtgcctccatataacttgtcagatacgtattcactctctctaaacgacttgactcctctccgtctgttccatccatataagtaaataatgcataggctgtcgttccatcaagaataacatcacctgcatcaattgtctgtaaaatattctctgtatcacggtaagaaatcgcattgttaaaatgataactcactccgcccgccacattcaaaagcttcttaaagtttgtgcttgagattacatcatatcctgaaatctttgctccactgatgtcttcaacaatctttgcaaacatctcatacttcttatcaccaaaagcgcgggcaacatctgccatatttacagaacttccggcttctgtcatcgtattcctgatttctttaagaagtgtactgcttacagatacctgcgcattacatggaagtaagagaacatccatggcttcggtctttgtattatacatattcagcgccgtataatctttattattcatatcatcatggacaaatacaagcgtattctccatgttcttattatcaactgttgtagcttcagtgctatcttctgttccgctttgatctgtctcttcttttaccgctttctttacacttgtaaagcttccggtcagataataagtcactccctcaaaagagccaactgcaatggctgccattaaaacgagaacaacacataatcttaaaaggaaagagaaaaatctttttataagacttggctttttcatcatagccctcctgttttattctatgttgtcgtgattgtgattcgacggattactccgtatttcatttgttaagtatagcaaagttctttttttattgcaagtttttactgtttaattcgttaagagaatgacagaggccatagagcgtgtttgaaaaatgctttctgcaagatgtgcgttacaatttgtgggagattttgcctgaatgagggcggcgtagtgggctacgtcaactgaatgaaggcaaaatctcccacaaattggggcgtgcagattgctggaatgatttttcaaacacgctctatggacacgctccctcaaatcttctcctttactatattaattcagcaaaagcacagctccctgacttgcggcaactcaaaatcaaatccatccaccgtcaaagcgtataatctgcccagtaagatattctggggattcggtaatctggtaacagaaagcggcggcttcttccggagaggcaaagcgtccgtaagggatttcttcggcaagcgaagcccgttcttcttcatcaaaacagcgattcatatcagtatcgatcacaccaaaactaactccgttaacggaaatatgtgaaggggccagttctttagccagagcctttgtaagagaattgacggcaccttttgaggcagaataagcagcttcgcaggaagcaccgacttctccccagacagaagagacatttaggatttttccactgtgacagtgtaccatatgaggaatcacagcttttgacatataaaatacagagtcaagatttgttcccataagagtatgccattcttccgaactcatatctgataaaaggccgatatgagcgataccggcattattaattaacaaatcaatctgtccgaaagtatctaaagttttttgaacaatagtagcagccgtcttttcctcggcgacagaaccaagacaagtaataacctgcgtctttgtagaaagctccttttctacggcagccaatgcttcttcattatgtccgccattcagcataagacaatatcctttatcggcataaaaacgggcaagcgcaaggccgattccacgcgttgcaccagtgataattactgatttcataaaatactcctttttatcaaattcacttactataccacaaaaggggacggtgttactatttatgacaatccggctacagtggcatcaacagtggtgtctcctttgccattcggcaaatcagaattcttgtgtttcttctctgagccagccggcttcttcttctgtaagatatggagcgattgtctcaaatactttctgatggtatttgttgagccattctttttcttttgtactgagttcttcggctatgattgctgaacgttcaaacggtacaagggtaagtgcgtcaaaacataagaaactaccataatcattttccatgtccttctggcatacgatcatattttccaggcggataccgaacttgccttctaagtaaatgcctggttcatcggaggttatcattccttcttcgaatacgcagtcatttcgtccatttacggatggacgataacggaaactgtttggtccttcgtgaacacttaagagataacctacaccatgtccggttccatgattgtagtcaagacctttttcccataatggagttcttgcaagaacatcaaggctctgtccgctacatccctgtaaaaagcgagccatttctaactgaatatgaccttttaataccgtagtatacatttctttttcttcctgtgtcaagctgccaagagcaattgttcttgtaatatcggtcgttccctcaagataatgtccgccggtatctgccagtacaaagctttctggtttcaattctacatctgattctttcgtagcgctgtaatgcacgattgctccatgttctttgtaagcaatgattggcgcaaaactaggctctacatagtgttcctgtgtatttctgaactgttctaactgctctgctgcactgatttctgttatttttgtttttcctatctgggactttaaccagtaaataaactttgtaacagcaacaccatcttttatatgggcatttcgttcattttccacttcaacaggattctttttcgctttaaataaaaatgttggattaacaccttctatttttttcactttctctggtaatgaagataccaatgccgtgttaaccgctgacttatcataatatatggatgcatcttctggcagtttctttacatcttcataaatctgtgcatatggagctgccttaataccctgcatatctaacaaaatctttattttttcagaaaggcatttttcctgtacataccaggtaagtttcttctctcctagtaaaagataacttaaaataaccggcgtggattctacatcatttccacgcatattaagaagccatgcaatatcttctaatgaagtaagtaagaaataatctgctttcttttctacaaggaattcccgtacacgcttaattttactctcgctgctctctcccgcatattctactggaagcggccatactggctgtgcagataactctgggcgatttttccatacagctcctgtaagatcaatgtctgtacgaacagcaacaccctgtgcatttaactgtgtgattaacttttctgcagaatcttgcataatacatctgccgtcaaatccgagagtttctcctttctttaatgtttgttttaaatattcctctattgcaggcactcctggctgtcgttccttccgaagcataattcctgaaccttctaactgcttcgccgcctgcagaaagtatcttccatccgtccacagtcctgcttcatccagcgtaactaccagagttcctgccgaaccagtaaaaccagaaatatattccctacacttaaaataatctcctacatattccgaaccatgaaagtcacttgtaggaatcaggcaggcatctacgccggtctcacgcattttttctcttaatagttctaattcccgtttcatttttgatctactcctataaatctacttaacatatttcataagtttcttgtaaacttactcattttatcatgcattacttttacaatatattttaatatacttttccctgaaaaaaatacgctgcctctatagaactactatgttatctacaataacccctataggtgcagcgtttttctctttattcttctgatgcagcgtccacgataagctgtgcacacttctcaatacccagacttcctctgttaagagccaagtcataattctgtgcttttccccaatcctgacctgtaaaatacttataattcagacctcttcgcacatccatatcttttacgcggttcttcagcttcagaccagcttcaccgtaaatctcctgaatacgattctcttttgtctcttcatctgcatataaaaatactttcagacagtcttctctgtctcttaaaatgtaatctgcacaacttccaacgataacgcatggttttgcagttgcaaaatctttgattaccttttctcttgtcttccataactgaacaagcggagaattagaatcttcatcaagaccaacaaaagagtatgcaaaacgctggtcagcagatggtgcaaactcaccatagtgttctacatactttctcgtaagaccagactcttccactacctttttaataatgtctctgtcataaaattgaatacccagtttctgtgctacaagcctgccgattgttcttccgccactaccaaattctcggctgattgcgataatattcttcttcattttctgtcctccctgtactgtaaaataacctcaaaaatcatctgtccctagtatataatattttatcaaaaatgcaaaggagatttactatttaattcattaagagacagacacccgggaagagagaagatatcctatatttgtgactttagtcgcggcggtttaaatgctcgctttatgcgctcgcatctaaaccttgctccgaggccacaaatataggatatcttctctcttcccgggctgtctttggctggattttgtttgaattaaatagtggttacggtaatttgggggagagagtagaaattttctgcttgctctaaaattattgtgaacagatgctttgcatttaaattgaagttataaaggttgaaaagggaaattgaagattatttcttgctccgatataatatagtcaagtcaaatcatccccctattcccagttattctcgagtaagcagaagacatcagcttctgtccccaaatctcctccccctgtttaattcactttctccatccacagcccagaagccaatgaacttcataagccatatttgtggtctcggagcaagtgttggatgcgagcgcgtggagcgaacattcaacgcgccgcgactaaaagcacaaatatggcttatgaagttcactggcttcgtctgtagttcgcttaatgaattaaatagtaacccactccattaaattggggatttcttttctataaattcgtccagagaatgcctcatgtggtagtgcaataaagtttgtttcgtcagcgcagatagttttgtatattggatctgctatgactgtttttgcttctgctattgccgcttttatctcttcttccgatgaaaaaagcaatacattttccccaatatattctggttcggtttctagtgggcagatgactgtagcatctattccctgtttgagtgccatcgctgcttttaatgactgggaaatgacagattcgcctatgatataaattccgttggttgccctgcttatgctttttcctgatgatgttacagagaaatatgctgcctgtgattttcccgtccaggcggcatctattaatttctcggcaatgatacctgcaaagcctttgactggtgtaccgatgacatacggtgttgaaaatcgttcttctaatacttttgcggctggaaatcccacggatgaaataacgaggttcacatcggcttcgccggctttttgtatgtcttctatgctacttcccatcgcaaaggtgctaatgatttcaaagtgcttgcttaagaattcttttatggaatctaaggtggagtttacggaaaaatcaagtggggttgctcctaaaatgtttatttttattttggaattactctgttttgattctgtattttctatttgcttttgttccgattggtttaacttctgctgatttttcttctttgtataagctacagataattcgtttgatacattttctatttctattccattttctttaaaatgcccatttgcatttgttggaagtactaattctcttgctactgtctccagcgccattcctgctccgcttacatagctctgcatcccactggtcgggaaataaaagactgggatttgtgtctgcttttcgatgacgcgggcgattccttcaaagtcggttccggtcattaagggaattggggtgcgtaccagggcaatgaaacaaggttttaattctttggctgcccgcacaatgtcattgatgaatttatcatcatttcccataatagcgtccatctgtgaaagtccggaaataaatacgaggctgtccatatcataccagcgtggttcatcgtgagtattataggtggaattgcagccggacgggtcatggataacgaccatgccgccaagttcataaagggcagaacatacccctgatacatctgctgtataggttgataatgttaccgatacttgtttcataaataaatcctttcatttatatacagctttcacatcccaagccttttcggactaccaaatcttttgtgtccttttttgtctgataggcttgctgtattttctggcagagttcacaaataccatcatagccatgcagccctccgccttctaccatatttacaaaatgctctgttcctgaaaagtaagcggctttctgaccgattgccagtattttttcctgtggatttcttggatatacccgcatatttggatgtatcgtcgcacatacttttaaattaggagcattttcttttaaccagagatagtcttctttttcttctgccgaaaaagcatccgtgaaaattctttctaccgaaaatccatgggaaatcagtaatcttgtaagtcctaaaagtcttggaacaacggtggcatctatggtgattttagtatcgccaacaagctcttttgtttcctgtaaaatgcgttcgcaccgctttcgtaacaggctggtatctggcatcaccgctcccggcatttcttttacgaggctttttaactgtgcattaatttcatcataatgaaatgaaaatggaagatagagaaacttcatgccaagtcgtttagataactgttctgcaccgtactttgcaagtggatagcaggcaatatttaagaaactttctgacatggataaatattcttcgtacccctcgcactctgtaatgtcttttaccgtgtatcctgctgcctttgcgattgtctttaattcggtttcttctcttgtcggaaaatcatttccgataatatttatctgttttaaattcttttcccgcatgggaagtggcttatataaagcatttcgcaacttctggtccggagtcagcccttccttttgcataatcggatccatgtaacaatccacgaaacactgttctggaaagcgacttcttagcgtatcataaatataggccaggtcgcatcccataaaatgatgcacacaaaccgtaaataaaagaacaacggatggcttcttcggcaatttgtgaagaatatcactgacaccttcaatgacaagatcctccatctgcccgttgaacaaatcttcttcctttatttctacaaaagaaaaacggtctcctgcgttcatttctgctgcagtcagaataacacctctgttacagtttgcgccgcatacataaatctggtgagaacctggcaggagcattcccatatgtacaatattccatgtgccgtgtgccgggctgttatattcaagtcccgggacaaaaggcagcggccatgccgcatcctgaaaaggaatctcctcctgtaaggaaggtgataatttttcttttatctgattattccattgttcgtcttttgcttttccgtgaagcattttaagcaaaataaatccctccctgtaaatccttcatattcaacttcttagatttcacaaagtgtacggatttttcctgcaagaatccgatactcctctgccatttctgaatccggatacgcttctatcaccgtctttttctgttcttctgcatcagtgacaagcgcacttcttgataaagttccgatgactttactgtgaatatcttctgctaattcctctacttttgcatcctcattttttacatttctacgattcaaaatgaggccgccaagctgtgcatatcctctgtctttgaagttttctactgccattgcaatattggctgccgcatggattgccatattttcaccagaagtaatgacaaatactttatcggcatagccacggcgcattggcatggaaaatccaccacagacaacatcgccaagaacatcataaatgacaacatccgggcggtatttctcatatgcaccttttttctccaatatctctaatgccgcaatgattcctcttccggcacagccaagtcctggcgaagggccaccggcttccacacagcaaacacctgcgaagccttcttttaccatttcttctaaggtgaaattttcttttcttgtccgtactaagtcaagaactgtctctactttttctccgtgacgcagtaaaactgtcgaatctgctttcggatcacagccaatctgcataactctgagtccctggctggcaaataccgccgccacatttgagacagtcgtggactttccgattccaccttttccatataccgctattttaatcatacttttttccttttatcacacttttgcataggcagctttcgccgtcactccagaaagtcgtccaatcttgccggacagctcactgattttcgtctgtggagcatcaatcaccaggctgataatgctaatatttttttctcggtaaggaatacccattctgcctacaacatactctgcgtaatcgtgaatcatttcatttaatttcgctgtactttcactgtcctccacgataatagaaagaacggcaattcttgtgtcttccatgattttcctttctccaattaacagattcttggtaaaagctctccacctggaggtggaagtaaagtttccgctccgatttctgttgtaactacaactcttcctggcatttcttctgttacttcaccaataattgcagcttctgaagaatactttccttctcgtaatttagctacgattgcttctgcattttcctttggtgcaaaaatgacaagacggccttcgcaggcaaggtaaagcggttctaatccaagcattccgcatacaccttttacgctgtcctgcaccggaattgcttcggcattcagacggattcctgttttactctgttccgcaatttcatataaaacagttccaacaccgcctcttgtcgcatcacgaataacgtgaacatcctttgtcacagataaaatatcctgtactgttccccaaagtggtgcacagtcacttgtcacatcagcatcaattccgaagtcttctcttgcaagcaaaatagtacagccgtgtcttccgatatctccgctgacaataacggcatcacctggttttgccatgaatccagaagtctctacgccctcctgaatctcaccaatacctgttgttgtgataaatacaccgtctacctgaccttttccggcaacctttgtatctccggcaacaatctttactccagcttcatttgctgttttttccattgccgctgcgattgcctctaatttctccatcgggaaaccttcctcaataacaaaggcgcaggaaagatagagtggctttgctcccatgcaggataaatcatttactgtaccgcaaatgctgagctttccgatatttcctcccggaaattctgaaggagaaacaataaatccatctgtggtaaatgcaatctttccctctttcatctttaatactgccgcatcgtcacttgtcagttctggattggcaaaatgtgctttaaatacctggtcaattaattcacttgtctgttttcctcctgcaccgtgagcaagagaaactgtttttccttttaagttatccatgatttttcctcttattgttttttactatatttttagatttataatttattatatctaatactctgtaagtgaaagttattctcccctgctattatactgataataagctgagcaggctccctcattcgataccatacaggctccaatcggatgaagtggtgtacagccttttccaaatactttacagtctgtcggacggcatttcccctgtaatacatctccacaacggcaggcaggactcgttcttccttccatcttcggaatcgaaaacttcactcttgcatcaaagtcctgcgcttcttttcgcaggcgaagtccagaatttttaatcataccaagtcctctccattgagaatcacatggttccatccattctttgatcagtttctgtgccggaatacttccctcttccgtaacaactcttggataggcattaacaaaaaacggtttgccttccgggaacttctttaataatacagcaaatgcagttaaaatctcgctggcagtaaaaccggttactataccgctgattcctccttcctcacaaagctttctgttcaatgcattgccggtaatcgcattaacatggcctggatataagaaaacatcagcactgtctttcaacatctcataggcacccggcattgttttattcgcagcaagaagtgcatagtttgtaagtcctgcctcttttgccatctttacagaaagacaacttgccggagttgttgtctcaaatccaacggaaagaaagacaacctgttcgtctttatgctctttggcatattcaaaggcatccatcggagagtagaccatctgaatcttgccgccaagacttctggcatccgctaaactccttgtacttcccggcacacgaaccagatcgccaaaggtacaaatagttacatttttctccaaagcaagccatattgcctcatcaataaaacctgccggtgtcacacagaccggacaacccggaccagaaatcagttccacctgcggcggcaaaatctttcgcacaccaagatgaaaaatctcatgggtatgtgttccacacacttccatcacacggacagcaggaccatcatagccttcaataattgcttttgctttttttaattgttctttcatagtaacccctccagaagatcttctgcctcatcctcatcttcttctgtaatctttgcaatcgcaattcctgcatgaaccattacataatcgcccggttcaagattctctatcagttctgctgaaacttctcttttcgctcctgacgcatctacaaccgccattccatctttcattgtcataacttttgctggtaatcctacacacataatttattcccctttttgtaaacttctcattgctgccaccgcctgtccaaggctgattcccccgtcatttggcggaagtaaatggtgtcgcagcacatgaaatcctctttcttctaacatggttacactgtaatctaaaagtaatttattctggtaaacaccgccacttaatgcaacggtattaatccctgtttcttctcttgctttttcgcaggcagagacaatcatccctgctaatctcctgtggaaatgtaaggcaagctgattactgttttctcctgctaattttctctctgctacttctttgacaagagataatgttggtaaataatataaatccgcttttatattccgatttatagagttgtttttctctacaatactcttctgcgctacatcagaaatactttttagttctccatagtctgtaattattccagattctgcaaaatcctcagaacctgctatttttttcttctgggcatccagccatttttcggccgcaaactgtaacgatgtagatgcctcccctcaaatgtagaggactttctgatgtcaagaatcgcactcaccgcatcaaataatcttccggcacttgtagactgtacagtattaattcctcgttcttccatcgtaaactgaagttttgccagctttggctcacaaagtcctaatgtttcaataatcagaagggcattttcttttccgtaaatctttccaagaagagatacggcaattctccagccttcttttgcagaagcatcgccacctgtctgtgcaaatggttcgatgcacccccagcgtgtaaaggaatcatagtctgccaacagaatttctccaccccagattgttccgtcggttccgtatcccgttccgtcaaaagaaacaccgataacttttttttcggttgtccattcattctctgccatacaggaaaggatgtgagcataatggtgttgtacgagaaatacaggaagccccatctcttctgccgccgctcttgtattataagacggatgcatatcgcaggcaacaatctgcggcttggtttccagcagttcttccattcgtttcacagactcttttaacgcctttaccgtccgtacatctcccatatcaccaatgtaaggcgatggataaaatagctgattctttccgatacaaaacgcattcttaagctcaccaccgaccgcaagcacctgacctttaaattcatttcccatcataaatggaagaggcgcatagcctctggagcgccgaatcatatacggctctccccggtaaaaatccataaccgtgtcatccgcacgaagccgtattttccggtcatgggaaagtatcacatcacaaagcccgctcagctcatttaatgcatcttcatcgtcacggcaaatcggcgctccagaagtattcgcactggtcatcacaaggcaatcagaaaccttcgtttcgtcctgataatcaaaaagcaaaagctgcactggcgcatatggtaacataactccaatctttggattatccggtgcaacactctcacaaagcgttcccccttcttttttcggaagtaaaataatcggcttctgatgcccgtcaagaatctcctctaaatgtggttctgtctcacattctcttctcacaacatctaagtccttcatcataacagcaaatggtttcatcggacgttttttcctctgtcgtaatcttgcaactgtttcttccttcgccgcatcacagcaaagatgaaaaccgccgattccctttaccgctacaatgccaccctcgctgatcacctttcttgtataacgaatcgcatctgctccccgttctttcctcccaagcaaatatacttctggcccgcagtcgttacagcagactggctgtgcatcaaatcttctcgtttccgcatgcgtgtactcatactcacatttctcgcacatcggaaactctcccatactcgtccgtactctgtcatacggcatggaatctaagattgtaagacgcggtccacaacaggtacaattgataaacggatgcagatatcttctgtcgttcttatcataaagttccttcttacattccgggcaaatggcaatgtccggggatacgaagatttctccttcttctttttcgctttctatgatttggaacttttctttggagtctgtttcagattcaactttatgaataccatcctcacccgattccacattctccacatccagtttcaaaataaccgcccgtttgggaggctcttcctgaatctgctttataaagctatgcacacattcttcgctgccctctgcaaagatttccacataaggtcccttattactcacacttccggcaatatcacaggcatcggcatgacgctttaccgttgggcgaaagccgactccctgcacgattccaaatactctgatgcagactctcatacgctctgtctcttctttcctgagattgcaaaatgcggtaagtcataccattctcctttataaaatggcacagctttcttcagtagcgaatcggcgataataatgtcatattcattttctttgatgtaagtgatccagtcatcttcttccttaaaaagaatatcctgttctttcttttgctctttattcatcataaaccaggatgcaacattgatatttgcagaaataaattcttccctcaacgtattcgccagcacctgctgatgaacaattaatatctttttctcagataattcttctacattcaacagtcctgctacctgctcttttttttctttccattctggaataatctccggtggacaaaatagctcatatggcgttccaaatttctgttgtaaatactttgctgctgcaattcctgccggcgaaacaacaatatttttctctgctgctgccgcctcttttacagcgtctaagccatcgcccattccatagcatacaacctttgaaaaaccttttccggcaaaatactttttcaggaaatcttcttcataaataccgccaaattcaagaggggttgctccgataattccaatacgtcctgactccacgtctttttcaacagcgaactttttaaacaattctttccatgtctttttctcaccatcatcgtaaagctttgttccgtccgtgtcgattgtaagcgccgaaattcctgttttcttttcaatcattcgggaaagtgcgcgataatccgttccgattactgcaggaaccggcgtaccaatcactgcaataaaatctgcggaaagcttctcgcaggcttttccaatcttttctactaggcggtcatcccgtccaagaatcgcatccatatcacgaagtcctgcgctgaaaatcgcactacgactctcaaaccatcttggctcatcaaatccgcatatgtttcccgcacagccgccggcatctaaaataataatcagtccgtgaaattcacataataccgctgccgcgcccgactggtccggagcaaatggggagagatattttctaagtcccttcatttaatttgtccccctttccagtattttctcttcttttatattttttgtactatttttcaaatttttttcttcacttttcgtatttttctcatccagtacccgttcacactcctcaaagaaatgcttcactccacgatacccaaatggctgtatatcatcactccactcaagctgtgctgcttctggatgatagtaaacagcatcctttccgataacgatatccactggattctcgcccggctcatagtaaatcatcgttggctccagattcgaataaatctttgtttctggacttaacttcgccatcttttcgatataaacaaaatcctctttcgacagatttccaaatacttctgctaccgcaaactcatatcgaatcagcgcaaatgcaagttcaaatgcattggcgttacagccttctccaattgcaaatactgcatgtggatactttttcttaaaagcttcttttgctgcaagtgcttcctcaaaataagcatcatcatcaaatttacttcctaatgccgctgcaaataatgtatattgattctttattttatcaagctgatatagccttgtaagttctatgtacggaattcccagtcgtttttgcatatcagccgccgcaaaacgtgcttccgcatctaataccagattaaaattcgcctctgccatatcaagatactcatcatagtttttacatcgggaaatctcacgaatcttttttatcccaagctgtcttaacagatcataaagttcactgtcatcttctaacggagcaaaatgtccaagaagattcacggaagtactcttctttttctttggctctaacagagaataaatcgactgtctgacatgaaccatcggcggctttcttccctctcttgtcaacgcatacatatagcaaggaagaaccgggattccaaccgctttttgtgctctcttacaaatacgctccatatcggttccaagcaaagcatctacacaagtaagacaaatcataacaaccgatggctttgtctccagacaatcataaatctcttctaccgcctgtggaaccttcttcaaatgtcttcccgttacaatatccgtttcatccatcatcagatagaaaaatcgctcactgtatccgccaagctcacttaaaatcgttgtattccttccacaacagcccggtgctaacaaaagcataaccgaacccggaatcgcaaggcctgctctctttacaccaaacccctgcgctcccggcgagttatacgcaagtgtagccggtgaactatagataaggtgctttgaggaaatcaattcttcaggaatattgtctcgacctgcttcggcaagttcttttgtggtaataaaatacgcttcttctgctttctttttctctgtctcttttgccatgatttctaccatacatcttcctccgctgtatcctgtgcattttccagaagttcttttgcaagatttaaaaatgcctgtgccgccggagattctggttcaccttcgacaacagtcattcccctatcttcacatctggtaatctcgtcacttcttggcacttcaccaacaatcggaagccctacggaatccgcaaactcagtaaccttctctgtctcgttttccacatttctgtgatttaacacaataccatacaccttcgcatagcttctgtcctcaaagttcttcaccgcattattaatattattggcagcataaagagccatcttctcaccagaagtcacaatcaacactttactcgcatacccctcacgaattggtgccgcaaatccaccacagacaacatcaccaagaacatcgtataacacaacatcaggctggtgtatctcaaataattccaaatcttctaacaagctaaatgtcgcaataattccacgaccagcacagccaagtcccggtgtcggaccacctgtttcaatacagagaactccaccgtaacctacctttgaaatatcctcaattgtctctgggtcttcatcatattcacgcatatagttcattaccggaatcggtgtcgtacccccaagcagattaatcgtagaatctgccttcgggtcacagccaatctgaataaccttctttcccatactggcaaatgccgctgccaaattactggtcaccgtggactttccaatcccgcccttgccataaaccgcaatctttaacataaaaaaactcctctattctacccctgaccgacagactgaccgtaaggtagaacagaagagttttgcacttttcgtactttattcttactattcttttctttgtttaaaacaaatcgtatctatttagaatctatacaattatagaaaatcaagcgtatttgtaatcttaatataattgaattaaaaatatctccatttctatacaacttatatacagatttactactcgattttcaattgcaaattctaaataatttcaaactattccagcgcggaaaaccttactgtcagagtcgatatttatctttctattattataactatccagactcacaaaatcaaatatcagttactatatacttacataactttgatttacataatcttagataattattcttttattgttttgttatttttttatcatagtcttattataacatctgagaaatgaaaggcaagtacattttccagtacagtacttatagtgacatacttcttctgcacatctctgcaatcctgccagaggctatatcactgtcaaacgtacatcccattcctcttaaaaattattttaaaagaagatagcttggcataccattctcataaatactacttacttcgccctgcaccaatggggttaagtaagtaattaactcttccttcactccattaccagcctcattaatccactctacaggaatcttcttctctttattcgcaacctcacgaatatcaacgccactgtactctaccgtatatggagcatcagacactcttgtaagagaagacattaatccactctctcctgctactgcaagcttaactgcattcgcgccaagattaccggactcctcaatatccgtcttacttaaaatatgccctgcacagcgctgtaacagattcaattctatcgaacgaaccttacagccaatctttgctcgaaccgcttcctctaaaatctttccagtaccagataacttcgtatgtccaaatacatctaactctctagattcttcctgttcacataagaaccgcccctctgtatcatgtacaccttcactaaccgcaacaagcacagcattcgttgatgccagcttttccttcacatcatcaataaaacgatccaatgaaaatggtttttcttctaaataaacaagatatggtacattaccattcttaccttccgctaatgcagcagccgcagtaagccacccggcatgacgtcccatcatctcaacaataattacattcttcggctcatatacggtaatctcctgttcaagctcacagaaaactgtagaaatatacttagctgctgaaccaaatcccggacaatggtctattccgcaaaggtcattatcaatcgtctttggtccaccaataaccttaatatcctctacacctttctccttacagtatgcagaaagcttcgctaccgtatccatagaatcattcccaccgatataaacaaaatatccaatattcatcttatgaagaatatcaacaatctcctgatactgactgtcatcttccttgatatcattaagcttaaaacgacaagaaccaagcgctgccgccggagttctctttaacttctccagcttttcctctgtgtcaaccttctctgtaagattcacaaatttctgttctaacactccctgaattccataacaagccccatatacctgatcaatctgttcttcctttatcgcctgcttaataacacctgctaatgttgcattaatcgctgctgttggtcctccagactgtgctactaacaaattcttcttcatctttctaaaatcctcctgtaaatctctgaaaaggttctggtgttccttcattcgatgcaatcaccttctgcatccatacaatatcccaccacttgccaagcttatagccacattgttcaaaatgtgccttcttctcatatccacgcgccgcatgaaacgcttcactctctgcattcggatgagtaatgcaggcaaataaattcacgatattctgcttcttcaacaactcttccatcttctcataaagagccgttcccacaccttttccgtgaattcctctctgcacataaacagacatttccgctgaccagtcatacgccctgcggtcataaaaaatccccgcatacgcataagcaataacctctccctcctcctcagcaacaaggtaaggatacctctccaatgtcttcgtgattcgttcctgaaactccttcaccgaaggaacttccagttcaaaagttatcgccgtattgtccacataataccggtaaatgttctggatagcaaaagcatcctccggcgtagcgattcgtatattcatttcaagcctccaaaaattttgtcgatgtggttattatacaataagaggaagagggggacaagacggtaattatagaaataatgtaacaatgcgggaatgtctgattaacataaacctttcacatatttcggtaatataataatatttcctcttctacatcgcaatttcgtactgctctttaagttcatttaacatattataggtaatacaacgctctttttgtaatcttcctacaacaattccaggtgcaatacctattttatttgcaaaatcacacacacttattgaactatagtcctgcgtcttcttaaattgctcaaactcttcctttggaatcaactcatctttcgcccataaatccgcctcattttcatcctgttctgtaatttcatcagtctttccaatatgtccaagaacaatgtgcccaagttcatgaaataaactaaaccaaaatctatcggcatcttttcctcttgccgtaagaccaatcacaattttcttgccatctataaacgatgcccctgtaaaaaagagccttgtaaatgtggcaaaaaaacaagtgcaataccacactgtgccaatttatcttttagctccgcactaaattccgctggtgtctctaatgtcatacttcggatttccggtaaaacacgaaccaatttatcaatattaatgtgtgctgtatcagtctgccttgctacccttttagcctcctgcgcccacgcgatcaatgcaaaatcacctttctcagtaatcgccaatcttctacacgcaatttttgtaatttgtctattctccaataaagaaagttcaaccacctcaaaatactttctaagattaatcaccctttcttttataagtcttgtttccggaacccatccaaacttagacatttgattataaggtaattgcttggctaaaacttcatctttatccattgtattttccgcttcaactttaattaatttctctctatagattgcttcaagattattccaaaactttgccggtactcccagtaccatctctaatcttactgccacctccgaagtcaactgaacatctccattaatcaatctgctaatatgcttttctgacatatccattctagcagaaaactctttctgactcatccctctgtcattaagctgctccttaattgtcgctccaggtggtgttgcaataaaactgcgacttctcaccatagtgctacctcccattcattgttctcattaatgataatctactatctcaagtatatgagcaatctcaatttcatttccgtgttttgtaaaaaccaatctatatggatgctccaaatctactgcgtattgccctttacgatttccttttaatgcatggcaacgaccgatacgaaactgaatcatctcctctacagtatccactgctctaatctcatctatacgcatatgaatctttgctgacatttggcttccatattctcgatcggcaactttggcattagtacaaattctttctattttccgatttttgtacgttatgtccaacacatcacctctctataaatttacctataaggtaaattcactatagcatgttttaatgtaatggtcaatgttttaatttacacggtaaaccatgagtaccctaaacaaaaaaggcactgatttctcagtgctctttcttattcttcatcttgcatatatctggtatggagtctgaccacagtaacagatcatctataaaacagcaatccgtatcttcttcatgttccatcatttctgtcagcaggaattccagataccgaaatggatttagtccgtttgcctttgctgtttctactatactgtaaactaaggcactggctttttctccatttattgtatctatcaatctccatgtgtgtttgtgcatacagaaattccgtaatgcagattcggtcgcattattatccagtgggacatttccatggtttaaaaattcgcagtcaatttaaatattttttgtacaatacatttatacctacttttctataaaataaataatcaaatgtaaaattcttaattattattataacataccaacttcaatttcaggtaaaaattttgccaattagataatcacttgatgtcctataaaacctaaatctctccttaataatctcgctacatattataactctaattctactagatcccataagtaataataccgatttattgtaataaaatatctttattttattagcaaaaaagcccattacaattcacagaatacctctgcacattgcaatagacttttgttcaaacttagacttggtgtaagcaccatttctaataaaaacctcatagatttttgtttcatggttatataatactcaattttttataatgtcaatgtatttcactctatgacgtatttcctttttctttagatcccttatttgttcctctactgtaagtttatttttcctcgcaaaacactatcttatgtattgattatatcagataacctatgatcatcataacaatgaattgcatatttttcaatcattgtgtattatcaaatcatctgcaaaatccaatatttctccccagaagaaatccctatcattttaatagcctcttcacaaaaatgagttaaatctaaataataatcttccgttccactattaaaatccaactgtgcagtatccaactccaccatctcatcttcatcaaatatcaactttctcacgtgacatcctcccccacctgtaggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaatcctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcccgttatcataaaactactcagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacactattttagcaatattttattatcaaggaacattttggcatatatttgacgccctgtgatactaaacttaccactttttcagtggcgtcctgtagaggtgggggcttcccaacctcggcaagtttggttctcgttcgataacactactgtgctaagcataagcgagctatccccgtgtgtcccacggttgtgttatattgtgtcaaggtcatgcatttaccagccgttatccgaaacagatttcccaaaatttagcgaccgcgacattgctttcatatccaaatcttctatacatacgcaatcatagtcattggctatctgtcttgactgcttatgcagaaagtcttttcgttgattggaaaccttttcgtgaagttttgccaccttaagcctttgcttattgcgattgtttgaacctttctgcattttagaaagcttacgttgtcctctcgctaattttttctctgtattcctgtaataccttggataggcaggttctttaccgttgctgtcacgatataattcatgcatggaaaaatccagacctaaaaacttttgcagttccctttcctgtacttgatcttcatactcaaaaagaatacttgcatagtattttccgcttggtgcctgacttactgttacagatttcaatctgtattcctctggaataatcctgtgctgttttaaccggacttggccaatcttaggtaatctcaaatatccattagacagagttatgttcccattgatgcagaccgtggaatagctgtttttattccgcttttttgatttgaatcttgggaaacctgttttcggctgtttgaaaaagttctgaaatgccgtatcaagatgcctgagtgattgttgtaatgcgatactatctgcttcctttaaaaatatgtattcttctgttttcttcattgcagccatttcttttgcacaaatagtatatgttacgtttgtcttgttctcctcatactgcctgatttttctatcaagccaatgattgtataccattctcacacagccaaaagtcttagcaaacaaaatcttctattcatcattcgggtatattctgaatttatatgctctgtttgccattccaacacttccttttcctcgaaaaaccgcctgcgatacttgaacacaagcacaagatgctagtatagtaagaatactaaatgtgcgttattatctcaatttattgtatctcaattttttattatttgactaaagatactataccaccattcgtcttcaaattataacattaagctcaacaattataacgcattgcgttaattaaatggcaaaaaaataagtcttacgacttatcttttttcaccattccctccatctctgctcgatatttaatcaaacgtaacagatagtctggcaattggcgtttttctgcttcccagtcctgaaccgtacgatatggtattccatagtaatcactgaattctctgcggttcattcccattttttctcgcagttcttttatttctcttcctctacccacaacctctctccattcaaccacaaaacgcattgcgttaattaatgatactgtatatattccaatctgtcaactaagctatgtcattttctatactacttcacctccatctcccgaaacttctctgccgctctcctatatgccggcacttccgctccatacttttctgccatccgaacaacttcatataccaacccgtctatctccgactgttttccttccataacatctctttgcatagatgtcgttgcttctttcggcaaattagaaaggatctttaaattacgttctacaaggtcttcttcgaaagtaattcccattgcgttagctagtgtaacaatttctcgaattaatgtcttaaaaagttccctggcttctccttctcgttggaaatctcctgcaacagcatgcaagtaaagtcctgcggttccgattggagacacataggaaaacttagtcaatgcatcccgttttatattatctgacaaaatgccatcaattccactgtctttaaaatcttgtgcaatctttttcaataatctttctgctttatattcaccatccaactgtccatttaatttcttcaaatcttccttttcccttacaccgaaaaatactcttaatatttctccatgctgcaataatactcctgcctgtttaatattagcagaaacgtagatacatccatccgtcacaagaacctttggaagtttctcctgaagatatgcgcccgttccataaacatttaataccggaacaactatcgtatttttatgggaaatgttttgaataaatggaatacaggaatcgagagaatattttttaacacaaacgaggattacatctgctttttctccttttgcttcataagattccatactttctgcaccgacaggcattgtttccgtctcgtttatccacattttttcaacagaaagtccctgcttttgcatagcttctaaatgtgcatttcttgcgatcagtgttacgtcttttcctgcctttgtcatgtagaatccaagtattcctcctgttccacctgctccgatgattatgtatttcatgattcgcccttctttcttaaaataaaatattctatttcctataatacactattttactatttaattcattaagcgaactacagacgaagccagtgaacttcataagccatatttgtgcttttagtcgcggcgcgttgaatgttcgctctattcgctcgcatccaacacttgctccgagaccacaaatatggcttatgaagttcactggcttctgtgctgtggctggagaaggtgaattaaacaggatgagggaatttggggacagaagctgatgtcttctgcttactcgagaataactgggaatagggggatgatttgacttgactatattatatcggagcaagaaataatcttcaatttcccttttcaacctttataacttcaatttaaatgcaaagcatctgttcacaataatttcagagcaagcagaaaatttctactctctccctcaaatccccgtaaccactatttgattcaaacaaaatctagccaaagacagccctcgaagagataagatatcctatatttgtgacctcggagcaaggtttagatgcgagcgcataaagcgagtatttaaaccgccgcgactaaagtcacaaatataggatatcttatctcttcgagggcgtctgtctcttaatgaattaaatagttattcatccttccatatatcgctttccaccccaatattctttgcgacaaatcgttttccatcgttatctacataatccttcaatgcccggtaaacatattttccaccatacaaaataatcggggcattggcaaatacaagggcaatattaatcaagtcgctgacataccagatgttatccagctctagacctgctaaaacgcaaagggttccaagtggcacaaaaattaaagcgcctaatgcacgtacaaagtttgtaaatgctttgctctttgtgattcttgttcctgcgatagaagcaaaggataccagcccgagcaatgaggtaaatgcaaatagtccataacagatgcagataaataaagagactgctccatctgcggctgttcctggaatcatttcttttaaagaggaaaggaatacatcaatttttgaatcttttaaaacttcccagttgtaagcggagttagtccaaatatgtgcgccacatacgataaatccgcttaatgtacaaataatgattgtatcaaggaatacaccgatagactgtacaaatccctgttctactggatgatcctgttcagaaatcgcggctgacattgtgatggttccctgtccggcttcatttgacagtaatcctcgtttgattccctgtgctaataccgtaccgaaggctccaccgaaaatagcatccggtttaaatgctccaatgactactgcctgaataaatgcagggaataagtgaatatttgcaataaataatccaacaatgacagtggcatataaaacagccatcactggtaccattctgtctgttactgctgttactcttttgattcctccaaatactgcgatagcaattccaatgataaggataatggccaatgcataatataagggagaagttcgatctgtgcttactccagtaaccgatgcgattgccgttcctgctgctgtaaatacatggaatgtctgaatagggatactaagcattgcataaatgataaacaaaatagctaaggcaattccgacaccttttttatttccagcaagtttctgtccgtaataaggcagaccgcctacatattcatctccatctttttctttaaatatctgtgcaagggttgcttctacgaaggagcttgccattccaagtaatgcagaaatccacatccaaaacattgccccgggaccgcctaaagaaatagctccggttactccgataatatttcccggaccgacacgcattgcggcacttaacataaatgcggctaatggacttactccagtagtatctttctttttctttgttaaaacctgaatacctcttttaaagtaacggaactgaacaaactttgttcttatggaaaaataaattcccattccaagtaacaggtagatggcaaatggaatacttccaataatcgggatgttcgcataccatgaaaaattctgtggaaatgtccacaaaatatccccgattggtacgatgtttgcaaaaaaggcattaattatttttaaagcgttggtcagtgcatgtatttttctttcctttcttttttcgttcgtgtttccttatttcttatttattttggtaatattgatacatttcttcaccagatgtccaccagacagaatcaaattcatcaatataatccaacagttcttctaaaagaccgattcttcctggtgcaccaatagctgccgggtcaagctgtaaaacgtaacataaaccatattcatagcatccgtaaaattcatctttccagttattaataacacccgtataatttgcaattcttccctgtccctttggaaatgccggatgataattaaatgcaaagtatggcagatcataattatcccaatgaattggaatctccagaagcgtttccccattttcaagatctttctgatatggacggtcatcatcacagagattactggaataatgcattccatatttctttgcaattcggagagtatctaaggtaagttccccttctggcgcacggaaaccgacaggagtaacaccgcatacattctgaattgcctctataccctttttcattgcttcttcctgctcttcttctgtcaataatgccatattttcatgtttgtaggcaagagaagcaatctcatgtccttcttcttttatcctttttaatttatcaggatactgttctgcaacccagcctggtgtgaaaaaggtggccttaattcctctttcttttaatatcgaaagaattcgatctactcctcttgtcattccatactggccaagagaaagggtctttggcatatctttgcagcttggatcaatctgaagccagaataattctgcattcagattaatggtaagcatagctgcacatttctttccatccggccacttcgttttttctaaattcattatatcctcctatctacttctctgactgctttcgataccagtcggcaatctccgttcctgttgctacccacacatcttccttggatgtaatatattttaacaaatggtcaagaatctgaatctttcctggacatccaatcacctgcggatgattcatataggaaatacaaaggccttctctgtaatgtcctttgaattctctcataaaattatcttccactaaacgataacttgaaattctgtcctgtcctgccggttctgctggatacatatgataggccattgccacataatcatccacttcccacttggtcggaatctctataaaatctgtctcttctccatcaatgactgtacgatatgggcggtcatcgcctcgcatggaactagaatatcggaaacctctctcatataataattttggagtattttttgcccagtcaccagaaggagttcgaaaaccagttacttcatgtccaattaaatctttaaatattttttgcgttttttctataatttctatctgttcttctgttgtctttccggcaaatctttcgtgtgcatagccatggtgtcctatctcatgtccctgctccgcaattcttttaatgacctccggatatctttcagcagtaagacctggcacaaaaaatgttgcctttacgccatactgatctaacttctgaagaattctatccacacatctcttcggaccatactgccctaccgataaagacttaatgtatttctctccatttttcagtcccctgtttccattctcccatgtggtatctccatccacatcaaaagtaaacattaccgcacatttctttccgtccggccatcttatatctcccatgttttttcctttctttcttcttctatttttttcttaactttttcagttatattagctcacttgattacttggtcacccactaattattaaaaaaatttactggaaactgttccctcttctaaaaggactccatacctcctccttcagaagacaggacacaatctccaacatctacgattgcaatgaaattcaaatctcattactgaaacatattcatacttgtaatcaaatgctcatccataagctttcttgccttttccacatcccgctcccgtattgcctgaataatcattccatgggattctaactcggcctctgcagaagttgcatctaatacatctgtaaacttcccgtacatcatatcaaaaatcgcattcaaaacgatctccaaagtctgggtcataaaagtacttcccgtctttgccgcatacaatctgtgcagttcaaactctccagaagttcttcccgtctcctcatacttctttcttaaatgctgcagtgcctcttctagttcatcaatatctttctccgatgcgttctttataatcagctccaccgccttttcctctaaggcctgtcttacttcataagcctcaatcatcgaatagcactccagattcttactcagactgtcataccgtttctctttcccggaaattgggctttctctcaaaaaacgtccctttccctgatgtgatacgataacaccacggctttctaatacatgaaatgcctctcttaatacattccgactgacattcagcttctcaataagttctctttctgaaggaagctgatctcccggttcaaaatcccccggtcaattaataaacataaatcttctacaacctgttcatataataatatgcgtgccggtctttttcctattttcattgtactctccaacttttctaataatcagctttgtccatcttagcacattttattcaatatgtatacgtttttctgcatttttatgcatcactttcaaaaaatattttcaacttacttatcaaaattatcaaaacttttcaaggccgctattctctcttaaagtgaaaaatctgtttaacttaacaagctcactgccactactgataataatggtatagtcaccgctgacagcaaggttgtaataacaaatatctccgacgcataatatgcatctctgtcatatcgttgtgcaaacataatcacggatgcccccgccggacatgccaatgcaataaatactgtaaatgccacctcaaactcaagtggcagcagccataaaacaacgagtcctgccaatggatatacaataagctttataaagctcaaatagtataatcttttgttctttaggctctttaaaatatttccctgtgcgagatttgctcccgcgacaatcattccaaggggcgtattcattgaagcaatcatttctaatggattttcaatgaactgcggcaggcgaagttgaaataaaaatagtatgattcctatcacaattgaaagaatcgccggacttaaaaagtttttccatgctccctttaatccatcgttatctcccattaaaataataccatgtgtccaaagtaaaagattaaaaactgtgatatatgccgtcatataaaaaacgcccttatctccaaggactccactaattaaaggaataccaataaatccagaattcgaataagacactgcaatcttctccactggacttcgattcctatccccgtggcatagaaactccgatgcaacaatcataaacaaaaacgtaagaaatgatgcagcaaacgcccatattaaaccttgcaaaagttctctgttaaaatcaatttgatacgactggataatcaacagcggagaaaccagcaataataatacattcgagagatgttttgtactgacatcattaataatctttgctttatagatgattacacctacaagtaatatgatgaacatctcaataatcttttttaatacgatcagtgacataaaaatatcctttctagcattttataaaaaacagataaaatctcaaatcagttcaaaaaatatttttcacaaacacactctagccaactccctgtaaggtcacaactgtctgaggcctccctcaaatctttctcaaaataaattctgaatttgcatgggcagccaacaaacagcttccaaagagagccgataccctatatttgtggcctcggagcaaaggttggatgtaagcggttaagcgaacattcaacctgcagcgactaaagtcacaaatatagggtatcggctctctttggaagcgtctcctttgcctgcggcaaatcaggagtttacaaaatcttcgtggtccatttgctcatgtcccaaacttcattcaccacgtctttatagaactctggttcatggcagatgagtaagacacttccccgataatcgagcaaagcacgttttaattcatcctttgcatcaacgtcaagatggttcgtaggctcatctaacaaaagtacattggtgtctctattgatgagtttacagagacggactttagcctgttctcctccgcttaatacacgaactttgctttcaatatgttttgtggtaaggccacattttgcaagggcggaacgtacttcgtactgggtaaatccaggaaattcttcccagatttcttcgatacagctattgggattctcgccttttacttcctgttcaaagtagccaatctgaagattttcgccctgttcgcagcttcctgaaagaggtgggattagtccgagtaaactttttaataatgttgtttttccaattccgtttgttccaattaaggcgattttctgtcctctttccatataaaaatctaaaggttttgataatggctcatcataaccaattacaagtttctttgtttcaaagagcattttccctggagtacggccgtaacggaaattaaattctggcttcggcttttctgcggctaattcgataaggtccattttatcaagttttttctgacgggacattgccatatttcttgtggaaacgcgagctttatttctcgcaacgaaatcttttaattcattgatttcctgctgttgacggcgatatgccgcttcaagctgtgctttctttaccgcatagacttcctggaaatggtcgtaatccccgacataacggttcagttcctgattctccatatgataaatgatatttacaacttcatttaaaaatggaatgtcgtgagatattaagataaatgcgttttcatagtcaagaaggtatcttttaagccaggcgatatgttcctcatcaagataattggtaggctcatctaacaaaagaatatctggcttttctaataaaagctttcccagaagtacttttgttctctgtccgccactcaaatctgtaacatcacggtctaaaccaagatctaaaagtcctaatgctcttgcaacctcttctacctttgcatcaatagtataaaaatcatgcaaagtaagctcatcctgaatcatgccgagttcttccatgagaatttccatttctttttcatcagcagtaccgagcatatcacaaatttcattcattcgctcttctttttgtaataaaggatcaaaggcagattttaatgcatcctgaatcgtcattccagcctctaatactgcatgctgatcaagataaccgacatttacatttttcgcccactctacttttccctcatccggcatcattttcccggtaacaatgctcataaatgtggactttccttcgccatttgcaccgacaagaccgatgtgttctccttttaacagtcgaaaagaaacatcgttaaatatcgctctgtctccaaaaccgtgggttaaatgctctacatttaaaatactcataaattctccttaaaattctatttattatcaaatttactataatgactttactataacaagacgctctcgtcaatcaaactctctccaactttctaaactcatctcaaccaactgtactttcaaactataataaactaaagcttatccaattcctgctgaatgtagtatcggagtatttttgtgcttgtttttgcgagaaaatttttcgtcagttgtacacaaatttttgaggcgtacgcggaacataggttgatgaaatttatgtgaatctgacggaaaattatccacaacggcaggtgcaagagattacgagtgcacattctacaaaaaaacctcccaaaggattgctcccctgagaggtcgttgctgctgtttgaaatttgtagttcgggtaaacgaaattaacgtttgctgaactgaggtgctctacgagctttcttgagaccgtatttctttctttctttcatacgtgggtcacgagttaagtatccagctttctttaatgctggacggaattctgggtcagcttcaagtaatgctcttgcaataccgtgtctgatagcaccagcctgtcctgtgtatccgccaccgtgtacgttaactaatacgtcaaatttatctgctgtggatgttaattctaatggctgacgagcgattacttttaatgtgtcatatccaaaatattcatccatgtcttttttattgattgttactttacctgttcctggtacgagatatactcttgcaacactgctttttcttctaccagttccgtaatatcttgtagtagccacttacttttcctccttaaattaatactagattgctaattccttaggctgctgtgcagcatgtttgtgatcaggtccagcgtatacgaaaagctttgtatacatctgtcttccaagaggtcctttaggaagcataccttttacggcaagttcgataacttcttctggtttcttgtttaatttttctcttaatgttgtttctttcattccaccaacatagtcgctgtgatgatagtaaatcttctgatctaacttcttaccagatactttgatcttgtcagcgttaacgatgattacatagtcaccgcaatccatatgaggtgtgaaaataggtttgttctttcctcttaaaacacttgcaacttctgatgcaagacgtcctaatgtatgtcctgtagcatcaactacataccagtctcttgtgatggtagatgggctagccataaaacttttcatgagtagttctcctcctgtttattctttaaaaatcaacggttcagatatgacttcctggctgtccggaccctccatcatatcaatcctgctatcgcaggtatatgacaaaatgcatctcggggcttttgagattacattttatatgcataccacgatttcatattatataacactctttcgtgtgtgtcaataacctttttcctacaaaatgtgggattttttaatttaatgatcccaatcgctataatgattataaatattcaattttctttaaaaacaatccttttgccggaacggtttctcctgcctgtgagcggtcgcaagcctcaaggatttgtttgacatgttctgggggatagactcccagtcctacttttattaaggttccgctaataatgcggaccatattgtagagaaatccttctccggtcactcggatgattactttctttgaaggatattctccttcggaaagaggatgtgcttctacttcgattcctgttacggttctcactgttgtctgtgcctgtgtttttgcggcacaaaaacttttgaagtcgtgggttccgacaagatattggctggcttcctgcattgcctgtatatttagtggaaaaatgacaaggtgggaatagagtctttctgttggcagaggaatcttcccattttggatatgatattcgtatgtttttcttgtatcacaatatcttggatgaaaatcaccgggtacttgctcggatgatacaattcggatgtcttctggtagctgtggatttaatgcaaaacaaagtttttctggcggaatcgttgtttctgaatcaaatactgctacatttccaaaggaatgtactcctgaatcggttcggcttgctccaattatgtgtatttcttcttttaaaaaacggctcaatgttttatttaatacttcttctacggttatcccgtttggctgaatctgccagccacaataattggttccatcgtaggcaactactaatttaaatcgtttcataaatctcattctctctctatctttaatttttaataagaactttacatcttaaaatttgtttgaaaaatgctttctgcaagacgtgcgttacaatttcataatttatttagaaaaatctctttaaaataaaactgcaaaaaatcataattaccacataaagcaacatgattccatacgcaatataatctcgtttttcataaataagcggatgcagtctggtctttccttccccaccattataacatcttgcatccatcgccatcgcaaggtcggatgctctcctgattgccgcaataaataagggaactaaaacaggaattaactttttcccccgctctaaaatatttccgctttcaaagtcaacgcctcttgacatctgtgctttcatgattttgtctaattcttctgttaaaatcgggataaaccgaagagcaatggacatcatcatggcaatctcatgtactggcacatgcactttttttagaaaatgaaaccctttttcaagtccatcggtaagttgatttggcgttgtcgtaaatgtcattacggatgaaccgatgaccagataaaccaaccgtacaacaagatagaatgccatccataatccctgtttcgcgattgttatcggcccaatttttacaagcatatctccactcacactaatcatatttataattgctgaaaaacaaatgataataaacagcggctttactccccgaatcatcatagacactggaactttagaaagctttactatcaaaataagaaatgctgtcgcaatcccaaggcttaataaacttttaggaaaaaataatgtaataacaaaaagcaatgttcctaaaagttttaccctcggatcaagtttatgaagaatggaatcagctttataatattgtcctaatgtcatttcccgaatcataagctgcctcctgctatatacgctgctaattcatctatatttaatggaatccctacattttttgttctttttgtttttatatactcttttgctttttcattcgaagcttctatctttttctcatgcatttctgtgcctttttcttttgtttctttctgatttatttctacgttttcttgggataactctatcgtcttctgagatacttcccgattcttttgattgtattgcatatcatgagaaaaagcattttctaaatcaatatctgtctcttctaatatttcttttaaatccagataaaattctactgcctgtggaacacctagtcccatttctgttaactcatcttttcgtacaaagacttcttctgttttgccatccattttaagctgtccattctccatcaccagaactctgtctgcatgatctgccacatcgtccatgttatgtgaaaccagtacgatagtgattcctctctctttattcaaatgatgtaagaggtcaaataatatctttttacccggtgcatccataccggcaaccggctcatctaaaatgaggtattccggctccatcgcaagaattccagctaatgctactctccttttttgtccaccagaaagagaaaatggagacactttttcaagttcattagaaagtcctgcaagttgcatcgcatgacgggctttttcctcacattcctttttatcaaagccaagattcttcggaccaaatgcaatatcttttaatacattttcttcaaaaagctggtattctggatactggaaacagagtgctaccttctgtcgaagcttttttaaatcatatttcttctcccagatattttctccattgaagaaatagtccccacttttcggctgaaaaagcccattaaaatgctgaattaaagtagactttcctgaacccgtacgacctataatcgccacaaattctccaggttctatggcaagtgaaatatcttttatggcatatttttcttctccggagtcttgttttttgtactgataactgatgtttttaagagtaattccttttgttgattctgtttttttaggctcatctatattcttagatgcgtcttcttttatatctgatgtttcttttaattcatgcgatttcttagatacttctgtttcatcagccaagttcagatcacctaaagaattgtcagctaatttttcatttctatcatctacagagatactataagaatcagattgtttttcaagacagtttccgtatcgactgttttccttagcttgactctttacattactcttgctactttcacttattgtcttccgttcagatttatactcagacaagactatattatcagactcgtccttctgaaaatgatatttcaaaaactcaagtaactgttgctttgtgtaaatctcttccggcacatccacacttttttttcttaagtcatctatcaaagcaacttcaaatggcagttccagattattttccactaatttttctggtattttaaataatgtctctggtgtacctttaagcgtaatcttaccatggctcattacatataaataatctgcctgactgacttcctgcaaaaaatgtgtaatataaataacggtaatattcttcaaacgttttaaatcatagatagcttccaacagttccttccggctttccgggtcaatcattgctgtcggttcatcaaatataatacattccggttccatcgcaagaactccagatatcgcaatcttctgcttctgccctccagaaagcgctcccggtgatgcttctctataagcagtcattcccgtagaagccaatgctttcgtaatcctcatttctatctcttccgctggaattcccatattttccgggccaaatgcaacatcttcctccacgatatttcctatcaactgattatcaggattttgaaataccagccctgctgtcttccgaatatccaaaatctgttcttcttttgcagtatccattccaccaacgtaaataataccacccgatggctttaataatgctgcaagctgcttcgcaagcgtagattttccagaaccattatgcccgagaattcccacaaaatctccttttttaatagaaagagaaatattgtcaatcgccgtatgttctataacttcttctttttctccagaatacattttatacttaaataaaagatttttaacgtcaattaaattcatctgacttttctccactataatcattgttcgtaaaactgcatctcacctttatcataagtttgacaaagctaacaaatattataacccattttctctcaaaaagatactggtttgatttaattcgatgtattcaacagacgaagccaggcccgaaagagagaagagaacctatatctgtgactctatcactgtgggttgaatgttcgcttaacggctcgcattcaatcctagctccaaggccacagatataggttctcttctctctttcgggacgtctcccttgcctgataaattaaataaaaaaatcgcacttagacagatgtctaaatgcgattccattgcttttcatttattaagttaaaattaaactaattcaataataacttctaatgcagcatcacctttacgctgagcaatcttaacaattcttgtgtaaccaccgttacggtcagcgtatttaggagcgtactcatcaaaaatcttctgagcaagatcaattttctttgtgtttgcttttctgccttttccttctacaggaacttctgttacagggtataatacttttaacatctgacgtctagcatgaagtctggatggtaaatcttttttgatttctttttcaactgtttcataaacagttactttctttccatctactacttctttaactctcttgccttcagcgtcttttttagctactttagcctgaaccttaacaacttcgaagttgtctttttctttaacaccaagagcgattaagccttcagcgattttgcggatttctttagctttagcttctgtagtacgaatctttccatgatataaaagctgtgtaacctggttacgtaataaagcttttctctggttagatgttcttcctaattttctgtattttgccattttaatggacctcctgtttatttttcgccatgcttactaataccttcagcttaagcgggtctatattactttgtttatggtaagaattactcttcgctattgtttaaggaaagacctaattcttttaatttagctaatacttcttcaagagacttacgtccaaggttacgaaccttcatcatatcttcaggtgtcttgtttgtaagttcttcaacagtattgatacctgctctctttaagcagttatatgaacgaacagataactctaattcatcgatattcatctctaatactttatcaaccggatcctgagctgtctctaccataacttctgctttctgagcattctcagataagtcgatgaaaaggttaagatgttcactcagaactttagcagcaaggctgactgcttcgtccggtgccagtgttccatttgtaaatacatcaagagtcagcttatcaaagtctgtaatctgacctacacgagtattctgtacagtaagatttacacgctctactggtgtgtaaatagaatctactgcaattacatcaatggactgatcttccgatttgttcttatcagcgcctacatatccacggccttttgtgatagtcagctctgcttcaaaatggctgtctgcaccgccacttaaagttgcaataactaaatccggattaatgatttcaatatcactgtcaacctggatgtctgctgctgtaactacaccctctccgctgaactcaataaaagcgcgttttggttcgttagaagaactgttattcttgatagccagttctttaatattcataattatttcagtgacatcttcttttactccaggaatagagctgaactcatgaagaacgcctttaatcttcactgcgcttactgctgcacctggtaaggaagataacatgattcttcttaaggagttacctaaagttgtgccgtaccctctttccagtggttccaccacaaaacgaccatatttattgtcttctgaaatctctgctatttcaattctcggtttttcgaattcaaacacgaatgggaccctccttttgggtaattaattggaaaatcaattccaagtttaccagcttccatatactacaattgaatgcctgtgtaatagcaggcattcaatttgaagaatcatttattatttagaatataactcgacaatgagtgtttcgttaactggaacatcgatcatgtcacgggaaggaagttctttaactgttccttttaactcttcgatgtcagcgtctaaccatgctggtacaagaacaccgccagttgcttctacgatatctttgtatctctgcattgtctttttgttttctttaatctctacaacatcaccagctttgattctgtaagatggaatgttaacgcatttaccgttaactaatacatgcttatgtccaacaatctgtctagcttcttttcttgttcttgcaaatcccatacggaatactacgttgtccagtctggactcaagaagaaccattaagttaggacctgtaagtcctttcattctctctgctgtagcatagtagtttctgaaaggtttttctaaaacaccgtagatgaattttgctttctgtttttcacgaagctgaagaccatactcactgatctttctgctggaacgaactaactttctgtttgattttttattcactcctaaatatacaggatccatatctaaggatctgcatctcttcaggactggagttctatcaattgccattcttacttacctcctattagactcttctacgttttggtggacgacatccgttatgaggtactggtgtaacgtctttgatgcttgttacttccagaccacatgcctgaagtgcacgaattgctgcttctcttcctgaacctggtcctttaaccataacttcaacagtctttaatccgtgtaccactgctgctttagctgctgtttcagctgccatctgtgctgcatatggagtagattttttggagcctctgaagcccatttctccagcacttgcccaagaaagagcgttaccttcagagtcagttaatgttacaattgtattattaaaagatgactgaatatgagcctgaccgtgctgtacattctttttaacacgtttcttcgtcacctttttggtcactttctttgccattgacgaaaccctcctataggattaatctatattacttatcactaaattacttatttcttcttgtttgcaacagttttcttaggacctttacgtgttctagcgtttgtctttgtcttctgtccacgaacaggtaatccttttctatgacggattcctctgtagcaaccaatttcctgtaaacgtttgatgttcatagcgatctcacgacgtaaatcaccctctacagtataatctgcattgatgatatcgctaagacgacgaacctcgtcatcagttaaatcgcgtacacgtgtgtcaggattaacgtctgctgcttttaaaatctgatctgcacttgttcttccaattccataaatataagtaagaccgatttctacacgtttttctctaggtaaatcaacacctgaaatacgagccatgtgtgcacctccactaaatattcatccgacaaaatccatcgctgccgcgtacggtgaaatgatcagcgtgtcttaagttcggattcgtcttgttttccttaatataatattattgtttaacgtcatgaaatacaatgtattcccggactacagcgtgaccgtcttatcgttacagacaaactgtaaactctttcgcgctgcctgacagtgctgtctttccgcactgtccttttacgaaaaaatattggtaaataattaccacagccgcttttcgtaaaactacttaatcgccatgacggtggcaatagttgatgatatccgcaaaactcaatagtctctcttgcatctgacgtaaatactcagattgaaaggatatcataccaatgacacaacaaaatcaagaatatactcttcactcccaaattctgctgaacccggaagcaaggtcttatccctgtctctgtttatgttttggattttcgcaaatgattctgattgcgcctttgcgtttaatgactttgcatttttcgcagataggcttaactgatgctctaaccttcacgattttctctcctttccaaaacgttcggcaattattatatcatctttctatattaaaagcaagcacaaatcttccgaaaaacgacagaattccagccattcttcagtcaaatcgtacaaaaccttttaatctatttatctctccagataattctgccttttgttaaatcgtatggggaaagttcaattgtcactttatcgcctggtaaaatcttaatgaagttcatacgtaactttccgctgatgtgtcccagtacctgatgaccattctcaagctctaccttaaacatagcattagggagcttctctactacctttccttcaacttcaataacatctgattttgacatatttaatcctcctgctttcttactttacgcccttccattccagcgatctcatcacagatcctctgattggcatcctccgaagaaatcagggatggaaaagcttctgccattctctcagagcgtatcatctgaatatgtttcttctttttccacttcggattatcaatggttcttcttcccccatcagataacccaatcatctcaccctcctgctttacaatcatgtaaacttttcctttatcatgaccacaaagggatgtggcaaaataacctaatttatattctagcataaatcttctccattaccaagtaaaaatttataaaaaaattacttttctttttgtttattattcatggctgtatcgtttttataatactccaagtgcctctttctcttctggcagcatcgtaagaatctcgcatccatcatcagtaatcgcaatcgtattctcataatgagcagaaagctttccatctgccgttgctactgtccagtcattatcaagccagtaaacatcataagttccttcattaatcatcggctcaatagcaagcgccatgcccttctgcatctttgcccctcttcttctctgaacaaagttcggaatctccggtgcctcatgaagatgggttccaataccatgccctgtcaggtcacggacaacagaatacccattgctctctgcataggtctgcacacctcttgcaatatcaactaaatgattgccaggttttgcaaacttaataccttcaaagaaagattgtcttgtaacatcaataatcctctgtgcttccggactgatttctccaacaccatgtgttcttgctgcatcagaatgatatcctttataaataagccctgcatcaagactcacgatatctccattctgaatatatctttttttagaaggaattccatgaacaacctcatcgttaatcgacacacatacagaagccggaaatccctgataattcaaaaaattaggaatgcagccaaagtctctgatcattgtctcacaaatctgatcaatatcctttgttgtcatcccctcttttaattccttacgcatttcctcgtgaaccaatgccagtaaacgtcctgactcacgcatcaatgctatctcatgctcgttctttattgtaattgccattgttttctcctatatccagtttttatcaatctctttttttagctcacaaaacatatcataaaatgattcttttgcccgcataacaatacctaatgcaattctttcattataagaatgtgccacattatttctttcttgtaaagcacgaagccacagttcctcatctttaatcatacctgctttataagctgtttttaaaataattttaggagaaccggttgctccctcctcatacccatgtgattccagaatttctttcatcattttccatgactgttcaaaacatacttcaaacaagccaaccagacctgttaaaataaccgtatcatacggtgggtcatatttataaatttctttcatattacacaaagccgaacaaaaattctcatactttttcatataaaatcttcccttcccgcataatagactgtcgcagctcatcctgcatttccctgctcatatcaacaatatcatattctaataatgttgatgtttcttcatcaacatccagagcaaatcttgcaaagtcaccacctacaacagccaaatcaatatcactggtacgtctgtagtcacctctggctcttgacccaaataatataaccttatctatattatattttcttgcaaaagttcgtatctcttctattacttttggttttattcctgtatgctccatgagacaccctctcatttataatactttataataaaaaaggctatcgcactataagagtgataccgcgacagcccttttcatttcaaacacactctatccaagaacctctgtaatcttttcaaatactacattgatatctaaagttccgtctactgttaaaagagaacctttcttatcatagtactcaattaaaggctttgtctggtcatgataaacctgtaatctcttcttaacggtttctggcttatcatcttcacgaagaactaacttttctccgcaatggtcacagataccctctttcttaggtggcatatttactacgtgatatgtagcaccacaaccaacacaggctcttcttccgcccattctattgatgatattctcatcaggaacatctacgttgattgcataatcaatcttctcattctgattgttcagtgcatagtcaagagcttctgcctgtggaatagtacgtggaaaaccatcaaggataaatcctttaaagcagtccttttctttgatacgatctactacaaggtcaacaaccagttcgtctggtacaagctgtcctgcatccatgtatccttttgctttctgtccgagttctgtattgttcttaatattagcacggaaaatatcacctgtggaaatatgaggaataccatatttctctgaaagtttctttgcctgagttcctttacctgcgccaggagcgcctaacataataatcttcattatttattaacctccagatttaacatcatcatatatttaaacatatacgattttattctaaccctattttgcaggaaatacaagaaaaattttgacttatgcaacaaaggagacgcctccagaaagagaaataagctatatttgtgactttcgtcgctgcaggttgaatgttcgcttaaccactcacatccaacctttgctcccaggccacaaatatagcttatttctctttctggaggctgttctttggctactgaagtaaaaacagatttcctattcttcctgctcccatttccaaatccccaataaatttgtaaaataggaacaagcagaagttatttcacattctttgtaaagctgatttctggattctttaaataagtataataaccagtatgtcttctgtataatgtcccatccaaatatcccatatttttaataactttaccgttcatttttacaatgaatgttgcccatttattttcaggattctttttccagttatgattgttataatattgatatctgtataagtttccatttttaacacaaattcggatagagaaatctgaaccgccgtttgtaaggtaattctgtccatctttttttgaaagtaaaagccatctgcctccatctttaaatgtatccatctttactactttgccatttttataataataaatctggcatcctgtgtaatgtctgcccgttttatcgtttcctgctccttgtgttcctcttaaaagtacaggggcattattgtccccaatatttacgatggcataatattttttattacttacatttttccttaaatattttttatatgcctttatcatagttgctgatgttacttttttaggagttatcgttttgattgcttttgacgtatttgtttttactttctgatttacagtctgaatctgcttttgctgagtgacagcagcctgcacatttctcgatgaaacagccatagtaagcggcatcgttgcagcaaacaaaaaagctactgccattacggagcttttgattttactctttactgcctgtacatctcctcgcttactttctaaaaccttgtttgtaaaatttctttctgtctttctcattttactcatcctttctaagataatctttattgaagccatcactgcttctacctatatatacgagataaaatgagaatcccacaaaataaaaaaacaaccttctgaagaatccccaaatcttccaacatgaattctgatttgtctccaccagccaaagacagcaccctaaaaaagaagagaacctatatttgtggccttagagcgaggattgaatatgagcctttaagcgaatattcaacccgcagtgatagagtcacaaatataggttctcttcttttttaggatgcgtctcctttgcctgcggcaaatcagaagcttacttttatactgcctggatattctttgttgcgattacatcaacacctgttcctgctacgttaggaacgatgacatcaccaatcttaactggtgcttttactacgaccggtttaatttcatcaagaatatcaaaaatctttccttttggaataacgtcttttgtctttacggatacagcggcaaggtttccaccttctaccttaacgattgatgtaactacacgtgttgggtttgttacttcttctcttgcatatttatctccacgaggacaagtattaccttttacatctgttacttcaccgttttccattgtaactgtaatctggcatccaagaggacatccaatacatgttaagtctcttttttccatgatactactcctcctcaatctttacagtgatggtctcaagaccttcatatgcttcgagatctttcttctttaagataacctgttccatctcgcccggagccataacctgttttctacgatgctgtactctttcatcatttaagtatacgctgatatagctattcttaaatacaccgcctacacggaaacgtactgtcagaaggtctgccatgttatctacatggatcgtgcttggtactgtgtaacgaacaccatcgattgctttaatttctactactttatcagatttctgtgcatctttgccacagttgttctttacataaagtgctgcattcttacctgctgttgctgcttcttctgaaacgtaatcaacaaggtcatgtacatgcagtacgttaccacaggcaaatacaccgtcgatgtttgtctcaagactttcgtctactaatggaccatttgttacagggttcattgctacgtctgcctgttttgataattcgttctcaggaataagaccacaggaaagaagaagtgtatcacaatcgtaatgtacttctgttccagggattggttttctgtctggaccaacttctgcgatcactacgcctgtcagtctgtcttttccttcgatatcgattacagtatggcttaataacagtggaatgtcataatcatcaagacactgtacgatatttctctttaagccgccggagtaaggcataacttctgctacaaccttaacttctgctccttcaaatgtcatacgtcttgccatgatcagtccgatatcaccagaacctaagatcacaacctttttaccaggcatgaaaccttccatgttaacaagtctctgtgcagtacctgcagaataaatacctgccggacgatatccaggaatgttcagggctccacgaggacgttcacgacatcccatcgctaagatcactgcctttgcctgatacataacgataccttcttcgcggttcattacggttactactttatctttagaaatatcacataccattgtatgtaacttatactcgatatttaactcagctgcctgatcaataaaacgagctgcatattccggaccggttaactcttctttaaatgtatgaagaccgaatccattatggatacactgatttaaaataccaccaagctgattatctctttcaataactaaaatactgtcgatgccctcttttttagcagcgattgcagcagctaaaccagcaggacctccacctacgattacgacatcataagatttcatagtattattcctcactttctttcaatactgatcctagtcttctttaatctttcctactaacagattggaaccttcacccttcttagtgatttctgtcattggaataccaagctctcttgaaagaatttccattgttctaggagtacagaaacctgcctggcaacgacccatacctgcacgagttctacgttttacaccatccatagttcttgcaccaagtggacgattgattgcatccatgatctcgccttcagtaatcatctcacaacgacatacgatgctgccgtattctggtttttctttgattaaagcattcttttcttctaaagtaaggtcttccatatggataacatctttacgttttgcgatgaagttgtctttctctgggaaatgatatttatcctgaatctgtccggcaattctctcagcaatcgcaggggaacttgtaagtcccggagactcgattcctaatgcatcaaagaatcccggtgcatcttttgcttcttcgataatgaattcatgttctggtaaatgagcacgaagtccggcgaaagaagtgataatcttattcataggaagttttgttcttgtgagatagctgtgctgtgctttgtaagctaaatcatcaagaatctcctgtgttgtctctactgcatccttaccttcaacgtctgttgcagatggtcctacgaacatattgccgtggattgtaggtgcacagaggatacctttacccatcttaccaggaagtgggaatactgttgctgagaagtaatctcctaattctttatccataaggagatactcacctctacgagcgataatatgtttcttatcttcgctaaccatgttatgaagagtatctgcatatacacctgctgcattaacaacaatcttagtttcaaatgttcctttattggttactacttcgtagtggtcatctttcttgatgatgttctcaactgcatgctcaaacttaaattcgcatccgttcattgcagcattttcacccatagcaatcgcaagtccccatggacagataataccacctgttggaacatacagagctgctactgtattatcagtcagattaggctccatcttaagagcttcttctttatcaataatacgacatcctggaacaccgttctcttttgcctgctctaaaaggacatctaacttgcctctttctcccggtacagtacagacaatgagggaaccgtttttcttaattggataatccagatcctctgccagttcataaagaagctcgttacctcttacgttcatctctgccataagagttcctggtttacagtcatatccaccatgaacaataccactgtttgctttggatgttccagatgcaacgtcatcacccttatcgattacgcacatatttacctgatacttggacaactctcttgcagtacaagtaccagtaacaccggcaccaattacaataatgtcatacatatcttcttatacctccatttgttttggccgcatgacaaaaagctacgcattccctttctgcttatctgagcattaaaatatatcggaaagaaataaaattcaccagccaattgcttacaaaaaaatacattccgataaaatcgcacaaatattaccgcttatgtcacccgtttctatatgtatatattacaacattttctttgttctgtaaattatacatttttacaaatgtgcttaattttttgtatttttccacgatgtttgggaaaattcccgatacaaaaacaaaaaattacccttgtgggtggtcaacagacgcagccgaagagagtggatagcctatatttgtgactttagtcgcggcggtttgaatgctcgcttgtacgctcgcatccaaaccttgctccgaggtcacaaatataggctatccactctcttcagccgctgtctttggcatgcctagaatggctcgttcaagggtaatgggaggaagatttgggggataagtcgggagatttctacttgctctagaagaaataaatcttctgccttctccccaacttcccccacggatttattaacagaataccataagagcttttaacagctataaactgtgtaatatatgtaaatctataccctgaatcccgccgcgttttttcagttgccaacgaacagaaggctggatgatttatagatagtatttgtggcctcggagctgctagaagtcaatattaaaaaaggttctttgtaaaggtattgattttgcgactttgtgttttttacaactgagtcaaaatcaatacctttacaaagaacctttttccacaacaccctccccgcagcgactaaagtcacaaatactatctataaatcatccagccttcgtctgtccccaacaaaaaaacctgcgctgttcaatcatagattcaacaacacaggttttctataaaaaattcgaatattattctgttaaaaatccggtatactgacgtactaatgtctgagattcaatctgtttcattgtctctaatactacaccagcgataatgatgatagatgttcctccaaaggagacattcgcaccaaagtatccgttaaagaaaatcggaattactgcaacgatacaaagaccaactgcaccgataaaaataatataagttaaaattgaatttaagtaatcaacggttgccttaccaggacgaattcctggaatgtaaccaccctgtttcttcatattattggatatttctaacgggttaaatgtaatcgatgtgtagaaatatgcgaatattacgttgagaaccaggtaaacgattaaaccgatagaccagttccagtgatctggattacaccagtttgactgatttaatgcgttgaaaataaatccggcagcaccttttggatctgctccaatgagttgcttgattaccaatggaaactgtaacagtgaggaagaaaagatgattggcattacatttgctgtatttacttttacaggtaatgttgatcctaatcctccaagctggcttccaccctggatttttcttgaatactgcacagggattcttctctctgcatcatttaaaataattgtaagaataatcgttccaataataacaatgaaaataatcactccggcaataattacgttgctaatctgtttaccttccataaatttctggtacagattatataaatcacttggcatacgggaaacgatgttacaaagtaagatgatggaaataccgtttcctacacctttatctgtaatctgttctccaagccacataacaaagactgatcctgctgttaagcaaacaatcatctccattacgatcagcggaccatagtttgacaaaaggccctgttttccaaaaccgattgccagaccggcactttcaagaacggaaagtccgagggtaacaaatcttgtgatgttgttaatcttcttacgtccgtcctcgccatcacgatacagctcttccaatgccggaatggcaatggtaaggagctggataatgatagaagccgtgatatatggtgttacgtttaacgcgaacaatgacatagattcaaatgatccgccagtaaaggaattcaacaggttaaaagaatctcctaacaaagagtttaaatactggctgattgtatcagtgtcaattcccggtattggaagctgactgcccaatcggcagataattaaaactactaatgtaaataggagtctttttctaatatccttcactttcagagcatttctgagagtttcgaacattaaatcacctcagcttttccgccagcagcttcaatcttagctacagcactcttagagaatgcgttaacctgaactgtaagcttcttgcttaattctccgtttccaagaattttaacaccgtcaaaggtattttttactaaaccactttcgattaaagtgtcgattgttacaacgctatctgcttcgaatctttcaagttcggaaacattgattgcgatgattttctttgagttgatacaagtgaagcctctcttaggaagtcttctgtataaaggcatctgtccaccttcaaaacctacacgaacttttccgccagaacgagatttctgacctttctgtcctctgcctgcagtctttccgtttcctgaaccatgtccacgacctacacggaaagcatcgctgtgtttggaacctgcagcaggatgtaaattagataaattcatttacgggtacctccttatctgcaattaaatttcttcaacttttaccaagtgtctaacatgccaaatcattccgcgtacagcatcgttgtcaggcatttcaactgttttgttgacttttttaagtcctaatgcttctacagttgctctctgtttaggaatagcaccgataggagacttaactaatgtgatttttaatttatctgccatctttctttcctccttttacagttcgtcaactgatttgccacgaagtcttgcaacttcttctggagtcttaatctctttaagaccagcgattgtagcaagtactacgttctgtttattgttagaacctaatgctttggaacggatattcttatatcctgcaagttcaagaaccgcacgagaaggacctccggcgatgataccggtaccttctggagatgcttttaataaaacttctgcacttccaaattttccaatgaaatcatgtgggatggaacctacttcatttacaggaaccttaaccagtttcttcatagcgtcttcttttcccttacggatagcttcaggaatttcaatcgctttacctaaaccagctccaacatgaccgtttttatcaccaactactactaaagcagcgaaacgcatattacgtccaccttttactaccttagtaacacgtttgattgatactactgtttcttctaattctaattgactagcatcaattaattcgcgcttcatgttatatcctccttgtttagaaattaagaccagcttcacgggctgcatctgccagtgcctgaatcttaccctggtaaatgaaacctcctctgtcgaagacaactgttgtgatacctttttcaattgctctcttagcaattactgttcctaaatgagctgctgctgcaacgtcattagttttttcaagctctgccttaacttctttctgtactgtagaagctgaaacaagagtttttccaacggtatcatcgataatctgagcatacatatgattgttgcttctgaatacggctaaacgtggagtagaagcagttccgctgatgcggttacgaagtcttctatgttttttagcacgaacttcacttcttgattttttattaatcattcttacttcctcctaattatttcttacctgtcttgccgactttacgtctgattacttcatcagcatacttgataccttttcccttgtaaggttctggttttctcttttctctgatttcagctgcgtactgtccaactttctgtttgtcgattcccttgatagtaatcttgttctgtccgtctaatacagactcaagaccttctggatcttccatttctacaggatgagaatatccaagagaaagaataagtttcttgccctgtttctgagctctgtaaccaacaccgttgatttcaagaactttttcgtatccctttgtaacacctgttaccatatttgcaaccagagttcttgtaagaccatgtaaagatttcattttctttaaatcgttaggtcttgtaacaactacctgattattttcaactttaatgtccatttctactggaagactctctgtgagtgttcctttaggaccctttacagtcacaacgttgttctctgcaacagtaacttcaacacctgcagggatttcaactggtaatctaccaattcgtgacatattgcacctccttaaattgtcggaaaagaccatgtcttttctgttttcagtagtatatatatctctcatcgtcttagcgatgagcttttcagaaaaggcttttaataaagcctttcttcttaagctaatcccgtaacctatacggttaatgtaatgcagttcttaaagaactaccatacaaatgctaatacctctccacctacgttcatagaacgagcttctttgtctgtaacaacacctttgtttgtggagatgatcgcaacgcctaaaccaccaagtacttttggcatattttcaacgtctgcgtatactcgaagtcctggtttagagattctctttaatccagaaataattctttcgttcttatcagcaccgtattttaatgcaatacggattgtcttaaatgcaccatcctcgatgatgtcataacctttgatatatccttcttttaaaagaatatcagcgatggaaattttcattttagatgcaggaacatctactgtatcgtgttttgcagtatttgcattacgaattctagtaagcatatctgcaattggatcgctcattgtcattattagctgcctccttcctaatatttctaccagcttgcttttttaactccaggaatctgacctttgtatgctaattcacggaaacagattctgcagattccgtattttcttaaataagcatgtgggcggccacaaattttgcaacgagaatattctctagatgagaatttctgtttacgctgctgtttaactttcattgctttcttagccattagaaatcctcctaactattttgcgtacggcattccaaataaagtaagtaattcacgagcttcttcatcagtatgagctgttgtaacgaagataacatccatacctctaactttgtctacctgatcgtactcgatttcagggaagattaactgctctttaataccaagtgcgtagtttcctcttccgtcgaacgcgttaggattaacacctctaaagtcacgtacacgtggtaaagcaaggttaataagacgatcagcgaattcgtacatcttgtcgcctcttaaagttactttacatccgattggcattccttctcttaacttgaagttagcaacggatttctttgctttacaaactacagctttctgacctgtgattttttccatatcaccgattgcagagtctaataatttatgattttcttttgcatcaccaacacccatgtttacaacgatcttaacgagctttggaatctgcatttcatttttatagccaaattttttcatcatggcagccttaatctggctgtcatactgttctttcagtctagtcaacttcggtcagcctcctctcttaaattagtcgattacttcgccagttgattttgcgaaacgtactttctttccatctacaaacttgaaaccaactcttgtaggctgtccgttgtggagaagcataacgttagatacgtcgattgctgcttcttcctgaacaataccgcctgcctgattctgcatgcttggttttgtatgttttgtagccatgttgatgccttctacaacaactttatgattcttagcgtcaacggaaagaacctttccttctttatcgatatctttaccggcaataacttttaccatgtcatttcttttaattttctgagccacagtagttacctccttataatacttccggtgctaaggaaacaatcttcatgaatttcttctcacgaagttctctagcaactggtccaaaaatacgggttcctcttggattcagatcatctttgatgataactgcagcattttcgtcaaatttgatgtaagaaccatctttacgacgagcgcctttttttgtacgtacaactacggctttaactacgtcacctttttttacaacaccgcctggtgttgcatctttaactgtagcaacgatagtgtcaccgatattagcatatcttcttgttgagccacccataacacggatacaaagaagttcttttgctccagtattatcagcaactttaagtctagattcctgttggatcatactatatctccttccgtgctaactatttagccttctcaacgatttcaacaagtctccatctcttatctttagataaaggtcttgtttccattacttttactctgtcaccaattctgcactcattgttttcatcatgagcttttaatttataagttctttttacgatcttgttatataaaggatgttttacgttgtctgttacacttacaacgattgttttatccattttatcgcttgttacgagacctacacgagtttttctaaggtttctttccacaacaaattcctccttcccgattactcagcactattctgttcagcaataattccctggattctggcaatatttcttctgacttctttaattctgctggtgttatctaactgatttgttgcgttctggaatctcaaattaaataattccttcttagcagctactaattcttcattaagttctgcgatggattttgttcttaaatcttctacatacttagttgttttcactgttatcaccgccttctaaatctgcacgagatacgattttacattttacaggtaatttatgcattgcaagacgtaaagcttctctcgctgtttcttcaggtactccagcaacttcaaacattacacgacctggtttaactactgctacccaatattccagtgaacctttaccagaacccatacgagtttctgcaggttttgctgtaaccggtttatctgggaaaatcttaatccaaactttaccaccacgcttcatataacgagtcatggctacacgggcagcttcgatctggttggatttaatccagcatggatcacaagctaccagtccgaaatcaccataagtgatagctgttccttttgtagcttttccagccatggaaccacggaactgtttacgacgttttactcttttaggcattaacattatttatcgctcccttccttagtttcctttgtaggaagtacttcaccatggtatacccaaactttaacaccaacttttccataagttgtgttagcttcagcgaaaccataatcaatatttgctctaagtgtctgcagtggaattgttccctcgctgtagaactctgtacgggccatatcagctccgcctaaacggccggaacaagatgtcttgatacctaatgcgccgtttctcatagttctctgcatacaggacttcattgcacgacggaaggaaatacgattctctaactgctgtgcgatgttctcagctactaactgagcatctttatctacatcaaatctcttaacttctttgatttcgatgatgagtttctttcctgtaagtttttcaagttctttctttaactcatcgattgcagaaccgccacgtccaataacgatacccggttttgctgtatgaataatgatctttacacgatcagaagcacgttcgatttctgttctagaaattcctgcgctgtataaacgatttttaatatattttctgattttatcatcttcaacaagattgtctgcgaaatctttttctgcataccatcttgaatcccaatccttgatgattccgactcttaaaccatgaggattaactttctgtcccattgtaaacctccttatctttcatccagaacaacagtaatatggcactgtctcttttcgattctgtaagcacggccctgtgctctaggctgtattctcttcattgtaggtcctttatctgcgtaacactctgctacataaaggttctctctattcatgccattattgttctctgcgtttgcaatggcagattttaataactttccaatgatttctgaagcatatcttggattatattctaaaattcctaaagctgtttcaacatctttacctctgatggcatcaagtacgaaacatgcttttgttacagaacatctagcgtaagaaagcttagcagatggtctgttatctttatttgcatttctctctcttttaatctgggatctatgtccttttgccatggatgaaccctcctttcaggctgttatctatctaactttactcttcttttcgtcttttccatgtcctctgtatgttctggttgcaacgaattctcctaatttatgtccaaccatatcttctgtaacatatacaggtacatgtcttcttccatcatgaactgcgaaggtatgacctacgaaggatgggaagatagtagaacggcgggaccatgtcttaataacactcttgtcgccggactgattcatcgcatctactttttttaataaacttgcatcagcaaatggtcctttttttaatgaacgagccatgagttacctccttaattatttaacgttctttccgtctcttgttcttacgatcaatttgttagaatgtttgtttttctttctggtctttaagccgagtgccggtttaccccatggagtacatggacctggacgaccgatactagccttaccttctccaccaccgtgtggatgatcgttagggttcataacagaaccacgaactgtaggacggattcccatgtgacgtttacgtcctgctttaccaatgttgataaggtcatgttcgatgtttccaacctgaccgattgtagcacgacagtttaaaggaaccattctcatttctccggatggaagtcttaatgttgcatattttccttccttagccataagctgtgcggagttaccagcggaacgaactaactgagctccttttccaggatgcatctcaatgttgtgaatttctgtaccaactgggatattctcaagtggaaggcagtttccaatatgaatttcagcgtctggaccgttcatgattgttgtgccaacctctaatttattaggtgcaataatgtaggacttctgtccatctacgtaacagattaaagcaatgtttgctgttctgtttggatcgtattcgatagcaacaacttttgctggaataccatctttatttctcttaaaatcgattaatctatatttcttcttagcaccgccgccacgatgtctaactgtgattttaccctggttgttacggccggaatttttctttaaagaataagtgagagatttctcaggagttttctttgtgatctctgaaaaatcagaaccggtcatatgtcttctggaaggtgtatatgggttataagttttaattcccattactttcactcctttcgtttccgaatatttgatatcacgcttttatgcgtataatttcctgttatctttaaatcttacagaccttcaaaaatctgaatatctgcactatcctgtgttaactgaacaatggcttttttcttagcagcagttcttccgtaaaccatgcctcttcttttctttttaccatttaagttcattgtgttaactttagcaactttagcaccctcgaacattctctcaactgcttctttaacctgagtcttagttgcatctggatttacgtaaaatgtgtatttcttttcgcccatagcagtcatacttttttcagtaacgactggctttaagatgacgtcataatattttaaatctgccattatgcgtatacctcctcgattgctgcaactgcctcgcttgtaacaacaactgtatcgtatttaagaatatcgtatacgttgatgttgtttaatgcagtagttgctactttaggtaagttgttagctgacttaaccacaacatcgtctttttcttttgttacgattaaagccttctcaactttgagattatctaaaactgctttgatctgttttgttttaatctcagctaattttaactcatctaatacgatgaatttgctctcattaactttagatgttaaaacagatttcattgcgagctgtttttctttcttattcatctttacggaataatctcttggtgttggagcaaatacaactccgccgcctgtccactgtggagcacggatagatccctgtcttgcatgacctgttcctttctgtctccatggttttcttccgccgcctcttacttcagaacgtgttttagccttctgagtaccctggcgtttatttgcaagctgtgctacaacagcctgatgtactaaatgttcattcacaggcactgcaaagatagaatcgcttaattcgattgtaccaacctgagcaccttccatattataaacagatactgatgccatttgtaagtcctccttccttaagcgcctacgctttaactgctgcttttaatgttactaaagacttcttaggtcctggaacggatccttttactaaaataacattattttctgcatctattttaactacttcaagattctggatagtaatctgtacatgtcccatctgtccaggcatcttcttgcctttcattaccttggatgggtcagatgccataccgtttgatcctgcatgacgatggtatttagaaccatgtgtcttaggacctgtatgctgtccatgtctcttgatagctccctgaaaacctttaccttttgaaatagcagttgcatcaactttatcaccagcttcaaaaacatcaactgtgattttctgacctaattcgtaattctctgcatcgtctaatttaaattctctgacgaatctcttaacagatactcctgctttttcgaaatgtcctttcattggctttgtggataacttttctctcatatcctggaagccaacctgtacggcactgtaaccgtcattttcaactgttttaacctgtgttacttcacaaggtccagcctgtaatactgtaaccggaattaattcaccatcttctgcgaagatctgagtcataccgatttttgttgctaaaatagccttcttcatttcgtcttcctcctaattttctacagcggattgcttcaaacatctgatgcaatcattctagtctacagcggattaccctctcaaaatgtcttacgttctagcctggataatcatactagctataggacgtaaaattatttctgtttcatcttgatgtcgatgtaaacacctgctggcatttcgagtcttgataatgcatcaactgtcttctgtgttggtgtaatgatatcaattaatctcttgtgtgttctctgctcgaactgctctctggaatctttatatttgtgaaccgctctaagaattgtaactacctctttcttagttggcatcggtactggaccgctcaccttagatcctgttttctttacagtttcgatgatgctctttgcggatgcatcgattaactgatgatcatacgctttcaacgtgattctcataatttgacttgccataaaaaaagtcgcctccttttcgcacttaatctagtacgacaagcggtgactgtacactcctccgtgtgtatcatctatgataccacactgcgtctctacgctgaatttgtagattgtaaatattgtacagtgacttgtcgccagtttctaaacttgacattcgctccacggaaaacctgcaatggatttttccatcacagcaacctcgcgcttctttgctatcatgtcacacaacgctttctattatacacgattctagggataaatcaagtgtttttttcaaaaagttttaaaggaatatcaagaaagtttttgtgcagattgacgaagagtagctccaatggggtgttgacaaggctgatgaaaccttagactttctattaggagaaagtctaaggtttctgtcttctgcaactccgttttgaagcactttgttttgtcacgttgagtaattaactaccgcttatgcagtacagctttgctcaaaagctttttgaatccacttctttccttagtatacttctcaatgcgctttcaatagctgaaaggcttttatacttacttcttagtgtacttcctcaatagctgaaaagcttctatacttgcttcttagtgcgcttcctcaatagttgagtaaactttttaatttatcggaaagtatttgaggaataggtcagatggctgtggggaatcttttgattttttctatccttcatctactcgctatattcttcattcagtattgtgaatttatctttgagtcctttggtgacggtgacttttttattctggtcgatgaaaatgccttcggctccgtaggtttctaaaagtttttggcctttttctttgccgaggacaaaacaggcggtggaaagaccgtcggagagtaagccgttgtcgcttactactgttacagaaatcagactgctttctgctggataaccggttgaaggatctaggatgtggtggtatctttttccgttttgcatgaagtacttttcgtagtctcctgatgtggaaacgttggttgtaccagagagggacaggactcccattgcttctccatccttgcctcttggattttgtacagcaacattccagttggttccgtctgtcttgcttccatataagaggatgctgcctccaacggcgatgaccgctccgcttacttctttttgttgttttaaatagttctgtgctacgtcacaggcgattcctttgcctactgctccgaggtcgagggtgcattggtcttctatatatatagaagaaatactttcatctgtattggtctttttgtctgtcgtctctaatctttcttcatttagagctgtattgtcaggcgtattattagcttcattgtttaccatgttatcagctgtattctgggcggtactatttatcgtgttattgtctgtatctttggctgcatctccatttttatctgtattatcttttatatctttatctacgttctttttagtaatagctgtattctgggtttctactttctccagatgtattttagtatacccagtatcttttaaagtattctttacttcctgttttgatggaactttagggttgtccccttctatgttccacagtcttgtgagtctgccgatggttgggtcaaaggctccgttgcttcgcctggcaagctctaaggaatcttcaacccacgaagtcatatcagaatccagtttggtttttgtgcctttttgtgcatcggcattaatttttgaaacaatgctgctgtcttctcgccaggaaagctgttctttctctaatttatcgagttcttcttttatgtcttgtgtaacatcttttgttccgtatattttttcacttaagacggtgctcatgacgaaatcggttttgctgtattcctgcggtgagttagttgatgtagaagtatctgctgttgtttgttcggatgctgatttcgtatttttcttgtctgaagaacatgctgtcatagataagagcagacagcctgccataataatagataaaatttgttttttcatattagatatcccattcctcgtcttccactattggaatattctcagatattagttctttctctttattttttgtcctcatttccttatctacgctcaacaccaattctctgcaagaatccaagccttctttacatatttctatgtcatccttacttacaaaaaaggaattatctcccggatatcttgcattaaaataatagttatttaaagcattgatatcacgttttactctcagcggaatctccatacccatttcgttagataaataattcatcaactgagataagttatgtgttcgtaaagttctcgttcgcaaatcaagtctttgctcatcatggtcatattggtctatcaggtgttttaaatacttctcggcagtattctgtgcattcgcagccatattattggctacatatcctgattcataactatgcataaaatatttataatcattttctgcaaaatctaaataagtcatgctgtccataattctaatccctccttttttatatttgtatggtatgtgctatttgatttcaaaaaaatattcctattttcaaagtgaatatctatatctatatcgttaaacgagctattttctatacgaaactttctacactcttctggcgttaaatcattatcgtttaatacaataaaaatatccaaatcactcattccatgtgcagaccctctggcaacacttccataaagatatacagcagatattgatttttgattgtccaattctttaatctttcttgctatattccctaacgctttcgcttgcttctcattcatcctagttaacacctgattatcttttacaatcttaacttctcctttttcattgattgcaccaaataacgaccgatgcagtcttccattcgcaagataaagatattgatccgttcttttcatagcacacctcctgttctgtattaatatctcaagattcaagaatgccccggcattcttgctgtgagatgctggagtcatctcacatctgatatactacctatactcctctctgcaataccctctttccggcttacttcctttaaaattaaggtatgtctcaccgtctaatgtcttccaccagaacgctccattctccagtatcatataactgtgttccgaattttcctttggaatagatacagagcctggattcatgtaagtataactttcatgtactctgcatactggaacgtgggtatgcccatgcaataatatcaacccctcctgtgtcttttcaaacatcggcggcagcttcttttcattaaaatgatgaccatgtgtcacaaagatattcaaatctccctctgtgatcatcgcatagtctgccataatcgggaattctaataccatctggtccacttccgcatcgcagtttccacgaacacagagaatcttttcttttatgttgttaagcagctctattacttttttgggcgcatatcctttcggcaaatcatttcgtggtccatgatagaggatatcccctaacaaaagtaatttatctgcctgttctctttcaaatgccttaagcatcttctcacagtaaaatgcagaaccatgtatatctgatgcaatcatccatttcattgtatttttctccctgttttttctgtctgattttgtatatctgattttgtgaggaaatcaaaattccaactgtacttttttgtattatatacttgatttcataacaggtaaagtcctttgcattaaatagaatttgccgcaggcaaaagagacgcccccaaaaagagtatagctcctatatttgtgactttagtcgctgcggtttgaggaatcttctaattactctatatagaatagcattaaaaatgcacatattacagaatgcgattattctccatttataaagccacatcaaaaggaaacttttggtaaataaaaaggaaaaagtatttgctataaagatatagcatgagctataatgaaagtgacaaaataagatattttcattgtggcagaaaggagcgtatctgtggacaaagatattaagaaatcaatatcagcgaccgataaagatgcacaatatgatgaaaaggcaaagaatctactggggcataaaattatacttgcacatatacttgtaaagacgattgatgaatttaaaggaatgaaccctaaagatgtcgtgcagtatattgaaggaaaaccatatattagcacagttccagtagatacaggaagcacaaacgtagaaaaagaacaagatggagaaaaagtaattggattaaatacagaaaatagtgaacttcatgagggactggcacggtttgatattatattctatgtgcggatgaaagacggtttatcacaggttattgtgaatatagaagcacagaaagcagaaccatcggcatacgatataataaatagagcagtattctatgtcagcaggatgatttcttcacagaagggtagagaatttgtaaattccaattataatgatataaaacgagtatattccatatggatttgtatgaatatgtcgcaaaactgtatgaattatattcattttacacaggaaagtgtagtcggtacttatcaatggaaaggtgacatagaccttgcaaatattgtcttaataggtttagcagaagaccttccagaaaaagaggaacgatatgaacttcatcgtttactgggagcgttattatccgcaaaattaaatgtagatgagaagtttgatattataggaaatgaatttgatattccattggaaagtgatatcagaaaggatgtgaatgatatgtgtaatctgagtcagggaataaaagaacaggcatatgtggaaggtactgagaatggaatcgccattggaaaacaagaaggaattactattggaaaacaagaaggaattgccgagactataattaaaatgtaccgaaaaggatatgaagcagagcagataagtgatatattagatatgacagccgaggaggtacgagaaattatagagaatgagtaagcttcaatttaatagataaaaaagaaaccgacataacgccggcttcaaaagagaggaaagtatgaaaaaatctatcaaaaatctgttgttgtttttgatggttttatcatactgtagatttgtgaacagcttgtgagcaaagaataaagataatctgacaaaacagaaatcactgacgtttttctgtaagaaataagaaatagaataagttaatagtattaaaagtagaccgctaggtttgacaactcatatcaaaatgaatgtcaaatctaacggtctgttttatttctatgccttgaagtattaagattttgatagtattctgtaaaatcactatagaagctatttttccagtaaccgtactacattttctgttccttcataacacgcttcctctatagcaatatcgttctcagaatattcgcccactcctgctttaatatgatacacatccccatctgatgtgtaagccagtgctgtaagattgtaatcgtggaactcgtcttgtcttttatcaagttttttaacacgaagattcagatgtggatattatgattttagtcgatatgtcagatttagaattaaaagcatatgcacaacaactttcttatatgacatacgattttaatttagattacactttagatattaagcctatcgccaaaagcaatgcacatttcaaaaaatggattattaactacccattctattccaatattcataaagaaggcatagttctgtatagcgcaacataaccagaaatgctttaaaacacacagaaaatcgagcaaaaccttctataacagatgcttctccaataaacttgaagagaaaaagtcaaaaaataaaaaagaatgattttatgactttgcgctatggaattctgactctggaaacttcggactgctttctcctgcctgagcatttcgaaaaaagctccagtggaggttttgagatgaagtttccgtttttcgaggcagaatggaatgtttagcgcaacggaataaaaccattctttttttattttttaactttttcggtcacatataagattgaagcatctgtatacgatacccttattcgattttcgtcagctttctaaagcatcttaaacatgtttctgtctatgtccaacccgaagtctcgccatcgcacgggaaagggaagcctgtgtatgataatactcctgaatactctgtttctgacgtattttttccaaagctctctcctttgcttcctgtgctcttgcgatatcgatttcctctgggcgttcgacactttctactaaaagagtgacacggttattaacaatttcgataaaaccgatgccgactacagcatactgccattcctcttccccttctggaaggaaacgcatctctccttcattgacagcaataaccatgttttcatgatgtgccagtacttctttttgtccgtcatatcccggaacgataacagactggcatcttcctgtaaaaaatacacggttggcggatatgatttttaaactaaatgtatttgaagccatatctacccctcctagtttgctgctttcatttcctcagcttttttctttacatcctcgattgttccgacattgaagaatgcattttccggatattcgtccatctcaccatcaaggattgccttaaatccacgaatggtttcttttactggtacataaacacctttgataccggtaaagttctctgctacatggaatggctgggaaaggaatttctgaatctttcttgctctgaatacgactgtcttatcttcgtcagataattcttccataccaagaatagcgatgatatcctgtaattctttgtatttctgtaatgcttcctgtacctttctggctacttcgtagtgttcttctcctacgatatcggcctcaaggatacgggatgaggattcgagtgggtcaacggcaggataaataccctgttctacaatctttcttgaaagtacagttgttgcatccaagtgagcaaatgttgttgctggagccgggtcagttaagtcgtcggctggtacatatactgcctgtacacttgttacggaaccgttctttgtagaagcgattcgctcctgtaattcacccatctctgttgctaatgttggctgataaccaacggcggaaggcatacgtccaagtaaggcggatacctcggaacctgcctgtgtaaaacggaaaatgttatcaatgaataataacacgtcctgtttcttttcatctctgaaatattctgccatagtcagtccggtttctgctactctcatacgggctccaggtggctcgttcatctgtccaaacactaaagctgtcttagcaagaacgccggattctcccatttctgtccaaaggtcattaccctctctggaacgctctcctacaccggtaaagatagaatatccgccatgttctgttgcgatattactgatcaattcctgaatcagtacggtcttacctacaccggcaccaccgaacagaccaatcttaccaccttttgcatatggcgcaagaaggtcgataactttaattccggtttcaagaatctctactgccgggttctgttcttcgaatgtcggaggttctctgtgaattaccatctttggagcgtctttgataggctctccgtcatcgattgtctcaccaagtacgttaaagagacggcctaatgttttctctccaacaggtactttgataccgcttccctcagcagtaacttccatatctctgtgaagaccttcactggctgccagcataatacatcttacaacgtgattaccaatatgctgtgcaacctccatcacacattttttatctccattttgtacttcgagagcatctctgattgcaggcaattcttgattttcaaattcaacatcgactacaggtccaagaacctgaataatttttcctgttttcatcaaaaaagcctccttatattatttccgctttttatttcttctttttcttctgcgacttcgctccggctattacctccgtaatctcctgcgtgatcgcagcctgtctggctctgttatattcaatatccagttcttttaacatttgtttcgcactgtttgtcgcaccttccattgccatcattctggcattctgctcacaggaaaatgcttctactaacgcaccatacacaaaacctactacatagtttggaacgatgtggtccataacctcttcagcagaaggttttaatgcaagtccctctaatgggatatcaatcggaactggaatcttaaagtctgttttcttcagtggcaggagctgggcaacctgtgcctcctcctgcattgcatttaccattgttgtatatataatgtaaagttcatcaagttgattttcatggtaaagctttaataaatcctcggcaattcttctggcacggcttaaagatggatcctgaacaacgaaatggaactgtttatcaatattaattcctttctgttcaaaataatgccgtcctaattcaccgagaacaaacagtttataatcatctcttttttcaagttcttcttctgcaagttttaaaatattatgattataagaaccagccagtcccttatctgctgtaatgacgatataaccggcttttctctttctttccggaatttctgcatttgtcttaaaataaatgctgttcatatctggaagatgtcttaaaattcggctcatttcagactgaagggtatagaaatacggctctgtgtccgctaacattttttttgattttttcagtttggaggaagaaatcatatacattgcatttgtaattttcaatgtatctttgatacttcgcatcctgtcctgaatttcttttgcacttgccataccaacacctgcctgttatttatcagtgtattcctttgctgcttctataatctttgcaattaattcatcagttaaatctttctttttctcaatttcttttccgatttcaggatgtttgagatcaagataagaaagaatatctttttgatatttctttacttcttttggcataacgatatcaaagataccattgtttgcaagacataatgtaattacctgctcatgtaaggataatggatggcataatggctgttttaacagttccatgattgcacgtccatgtgctaactgtgcctttgttgcatcatcaaggtctgatgagaactgggtaaatacctccatctctcgatactgtgccaggtcaatacgaatacttccgcatgccttcttcattgcttttgtctgtgctgctccacctacacgggatacggataaaccaacgtttaccgctggacgcataccttcgaagaaaagattactctctaagaatatctgtccatctgtaatagaaattacgtttgtaggaatgtaagcagatacgtcgccggcctgtgtctcaatgattggaagtgctgtgatagaacctccaccaagcttatcactaagacggctggaccgctctaataatctggaatgtaagtagaatacatctccaggataagcctcacgtccaggagaacgctctaacagcagggaaatcgcacggtatgctaccgcatgtttggataagtcatcatatacgattaacacatcttttccctgatgcatgaaatattctgctaacgctgtacctgcatatggtgcaatatactgcagggatgcaggttcacttgctgtagaggataaaacgatagaataatccattgcgtcatatttctctaaggtatttacaatcttggcaacgctggatgccttctgtccaattgcaacgtaaatacagataactccttttcctttctggttaagaatcgtatctgttgcaatagaagttttaccagtctgacggtcaccaatgattaactcacgctgtccacgtccgattgggaacatggagtcgatggaaagaatacccgtttccattggggtatctactgactttctctcaatgataccaggtgcttcttcctcaatcggacgataaccatctgccttaatctctgcgccgccgtcaattggctcacctaacgcattaattactcgtccaatgtattcgttaccaacaggaatacctgcttttttctttgttctaactacttttgttccttctttgattccagtatcacgtccgaaaaggattacaccaatctcgttctgacggatatcctgaaccattccttttactccattatcaaaaacgacaacctcaccgtacatcgcatggtcaataccataaacagtaacgattccgtcacctacatatatgaccgtacctgtctcttcacttgtgttgtccacatcaaaattttcgatttcactctgtataatagagattatatcttctgcactgattgcgcccacaagattcacctccctgttaattttctttctaaccgtctgagtttaccttcataactgtggtcatactcttcataaccgacacgaacaacataaccaccaagaagggaagcatctgtctcttccgaaagaacaaccttttcatctggataaatgctctctaactgcttctgaattgcttctttttcttcttttgccttgtcatctgcataaatgacttttgcgtgaagaatgtgattcattttatcccagtattcataatagcagttaaaaatatctgtgatctgtccgatttcaccaatccggcacatcatcttcataaaattctcaagaagttccggcattccactctgtctcgcaattttgtcaagcactacctctttcgcttcctctgaaacaactggatttgtcagagtctcgagaaggaaaggggccttcgtgaaaattttatgggcttcttctacatcgcttcttgaaatattcagacggtataatactttcgcattatttactgccttctgcgtcatgggcctcacctgtctctataatctttcttgcggcgataagtgcaagtttcgcaatctcaccctgcacttcctgctgtgcctgtttctgttctttttcgatatctgcttttgctttctcgatcattctgtccgtcttcgcctgtgtctcaagcactgctttctcatgctcttcttttgcctgatctcttgctgcaagaataatctcatcggcctttacatttgccttctgtaatttttcttcataatcagcctttaactgaagggcatcatcctgcgtttttttagcagaatcaaactgtccctgaatcaattcttctctccgatgaattacattcataaccggtttatataagaacttacgaaaaatcgcatataatacaagaagatttattacaatcattaccatattccatggatttatattaagcatattcttcgtccgccttcctttttcattaaaaatctgtaagtttccaaatagccttttaagcttttattatttaaggaaaaggatgattaataatgcgataacgaaaccgtaaatagctgttgcctctgctaacgcacaaccaagtaataatgctttactgatcttactttctgcttccggctgtcttgcgattgcatctgttgcggctgcggtagctttaccgataccgatacctgctccaatacctgttaatactgcaactcctgctccaattgctacaaataatgctgatgacataattacaacactccttttcttttctctttaaattttttgttgttttcttattctgtcgcttccttaataaacaacgatgtaaggaatacaaatacgtaggcctgaatcaaaccatcaaaaatatcaaagtaacagctaaacactgccggtaatactgccggaacaattaactttaataattccatgataacgaaagaaccaagtacgttaccaaaaagtcgcatgcacagagataatggtttaataaaaatctccataatattgatcggtaagataattggaattggttccgcaaaactctttacccatccttttgctcctttttgtctgatgccggctacctcaattaagacaatactcataaatgctaatgccgccgtcacgttcatgtcttttgtcggtggtttaaaaccaagcagtccgataagattggcaataccgatgtagagggtcactgtcataagatacggtatatattccgctccatgttctcccagtgtgtccttgaagaaattgtgtccgccgcttacgattgtttccagtatgatctgtccacgacttggattttctacgcttaaatttctggttaacgctatacaaagtaccagaatgaccgccatgatgatccatgttactactacagattctttaaccgggattcctccgagtaccggaatcgtaaagacagtgtcgcaattcaactctttcatcagttcattgaccagagcatccatctgccacactccttcctgattcttatattggtgacaatcttctttgctaccctatttaataggaagagattgttcgccctgaaccattgctacacattctacccctctttttatttatgtggaaatgttttatatttttatctatcatgtaaattttacatagtgcaaagatttctcatataaatacgatttttttattcaatttgacaaaacgatttgtatgaatatgagaaatcttgtcagaaatcagtcagatttgataaagaatgtttaagaaaaaaagaaagaataattacaaattattataacaattcggacataattcttaaaatatagagactatttttattttttgaaagtctgtatatctctgaatcactataaattagctttcaatcataattgttatatctttataacatacctggaaatttctttaaataatcacgctttgtcttttaatttcgtttcaatataattatttataaattgctttaatgcattagctgctatactaagcggtgttctttttgactccacaaggcagatctgtctttgtgggattttctctataaggggtacttttattattttcccatcttctaaggcttctatacctacattttctggtaaaaaacctactccaagatcatagacaaccatcggaagaatctgatgaattgttccggcttcaatatctggatttaactttaaaccatatctttgataaaaattactgaaaaactcatatgactttgttcctctcccaagacaaatgagtggataatcctgcatctttgaaagatgtatcggcttctcacataattctttatgcgagctgctcactaccattacatctgaaaaatccatcaaagacgtagattttaatgtagcagggatatcggccggtgtagatactactgccagatcaaccagaccatcttttacttcctgaatcgtctccggagtagaatgattggaaaggcggatgcggatacccggatatgcttttcgaaagtctgccattacctgtaagatcagcaaatgtaatgcgatctcacttacaccaacggttataattccactctgcagacttttatcattcgccagttctaactctgccagttgaaaatgctgatatgcaattgttacatgcttgtatagcttctccccttctcttgtaagtgttactcctctatttgaacgaataaacaaacgacagccaagctgattctccagattattcataaaatgcgtaatattcggctggttactcatcagaatctctgccgcctttgaaaagcttttatatttagccgcataatagaatatgcgatagtaatcgtatgtaatttccatttgtgtttcctcctttatctcgtcatttgacagacgaaactaagctaatagatatatggcagctgttccgtatcactgcgctcataatgctcgcccgcattatgaacttgctcaaaagtggcactattccatatccgatttctatctctgaagaagaaaggggatagtaatccaatttaatccagcattcctttagagcgtgtttgaaaaatgctttctgcaagatgtgcgttacaatttgcgggagatttcgcctgaatgagggcggcgtagcgggctacgtcaaccgaatgaaggcaaaatataccgcaaattggggcgtgcaggttgcaggaatgatttttcaaacacgctctagtatttctataaacagaaaactctaaacatcttatcttggcagatgcggcttcggagcaagtgctggatgcgagcgcaaaagcaaacattcaacacgcagcgactataaagcagctgtcaaaataggatgtttagagttttcgtctgtttatacaaaatgctgcttgattatcggatttaatctctttgttaatatcccgcttaagattccgattaagattccggctacgagtccagaaaggattaaaattgggagatagtaggctaatgcctttgtttccaatacaatcatggcaacgataatctgtcctacgttgtggaatatgccgcctgctacgcttactcctacagaagaaaacttctttgttttctttaagagtgccataactagcatactcattgccgctcctgctgcactgtagaccattgcgaatccgcttccaaagaggaatcctgataataggattctaagtacggaaatcaggcaggctgcagggactcctactatataaagaagaagcattgtaacaatgtttgcaagtccaagctttactccgggtattccaagattaatcggtataagctgttcaatatatcctgctactaaagcaagcgcaagaaacattccataaaaagctgtctttttagcactcatatgctatctcccatctatttcttttcccatcgtccggaagcaccgcatggaagaacaagtccatttgcactgacaggaagaccaacctcatctgcactgacttttccaccatgttttttcgcaactgctgttcctaacatataggaaagaacggcaggctgtaatcctgttgtataggaattgattaagaagaacagcgggtctttggaaagaagcttttcacaaagacatactaaagaataaatcttctcctcaatcttccaaatctctccctttggcccacgtccataagatggtggatccataataattccatcgtaatgattgccacggcggatttctctttctacgaacttcacacagtcatctacaagccagcgaatcggtgcatcaccaagaccagaagcaaccgcattctcctttgcccaggtaaccattccttttgaggcatctacatgagttacagatgctcccgcagctgcggctgcaagtgttgctccaccagtataggcaaataagttcaatacttttactgggcggcctgccttcttaatcttatcagaaaaccagtcccagttgactgcctgttctgggaaaagccctgtatgtttaaaactgaatggttttaaatggaaggtaagacttctataatgaatatcccactgctttggaagatcaaaaaactcccactctccgccaccttttttgcttctgtgataatgtgcatttaaatgtttccagtgtttatcttctttttttgtattccagattacctgagggtctggacgaagaagggtgtatttgccccagcgttccagtttttcaccttcgctgcaatctatgacttcatattctttccagttatctgctaaccacatattttttcctcgcttaatttaaatctaattatgaaaatattctaatcgctatagttttccctgtcaatagaaacgaaacttaaaatacctttatttcagtttttcacactcttttttcagaaaatgtactgcagcttctgcttcttttctagtgattccttctggtgaatacaccgctttctggcgaatcctcatacaaagatgtaactttttcggttccacttctctgtcaaaggtacgaagtcttttttcaaaggttcttacacgattatcttttattttttcttttccatatattgttttacacaaaatatcgtaccagaacataactgcctgactatacttttgctgttttaaaagtttatctgttttataatttcggtatactttttgcagtcgttttctaaatacaaaaagcaaaagacctactatgaaaataaagaaacatagaatatacaggattttatgaaccgttcttccacctttgctttgctttgagcgattctgtggaatctgctgcggtgtttctactgttttcttttctgatttcttttctgttgtctgttctttttcctgctttttttgttcctgctgtttttcttgtttcttcttatcgtcattttctaaagattgatctgacgaacttgaattacttaccgcagtttcctgtgtctcataatacggtgttcccataatgttttcatatttaggagtaacttctaccggaatccatcctattccatccagataaatttccggccatgcatgcgcgtatttttgtgaaacagtcaccgtctctgccgttcctgcctcttttaccgtttccggtgtaagaaggtatccttccacataacgggatggaattccataataacgaaacatcattactgctgccgccgcatactgcacatcgtatcctgtttttttatcttcaaaaaaccattgggcaaaatcttcatcttccgagatacttcctggattttcattataggtaatcgatgttttcatgaagctttttacccggtttataattgctaataccgatagattactttgaagactcccttctgttgcagaagaaatcaatgtttttgtttctttatttaagaaaagacatgttgcatttacatattctttatagctttccgtcattttttttgaggaaagattcttatcctccgtcttaatattggtagacgatttcaactttccagccattgtttccattgctttaaaagaatattctcctgctccttttattccagaagcgaatatattctctgttttattaatcgctgccgtcccttcttcttcatatattgttggtaaaacagcactctcataaggaagataaagatactttcgattcgcccctacattttttacagataaactgtaaagagacggatctgttttcccttccgaaagctttttctgccttacaaaatgatacattactgtatttccgtaaaattctttattatgaagccataataaagattcgtatgcctcccggtcagaagctgcaagcatactcctgtctgagccaaaaatattccagttatttgtacttgctttccaacaattattctcataagttgttccaacaaatcctttcagataataactgtttttcttataaatatttactttaagagcctcttcacctgtccgcttcatcttctttgcctttgtaagctgaccttccggaagaacagatacatcctctttatatcgttctttattccacttcttttgaattgccgacatctgtccggtatttgtcattcctgagaaagttcctaaaagaagtaaaataataagaattgaagttccaagtactcctccccaaaaagacggagcaaagaaaaagaaacaaaaaatgagaaagcttaacactgcaaacaattctggccgaactccccatacaaaaaatggaaaagcaaagcagatcgctacggtaaaaaataaaatacaaggctggactttccacaacaatgccataaaaagaataagccacaaagttatccccaatattccgacaacaaatggaaaaaactccacatttcctgtctgcatatctaccgatgtattttgaattatacgatgaaaaatatttttgctctgtccataatctgccagataatcaaagactgttcgggagaaaatcaataaagctcttcgaatattctccatagaaagaatgaaaaatggaacaaaaaaatacaaaccgcttataaaaaccgtaaaaccttttccaacagatatcccaacgaaatacaataatataaaaaaggctgccccgataaaaagagcaacacctgctgtatccatttcaaaacgatcggcagcataccagataaaacataacagcgcagcaagccacacatacccggcccgcatcatttctgcccagccaaatccactctgatgattcaattttttaatgtgaaatgagtttttatgctccataatctacactcctgtacgctgtcaaaatccgatcaatatcctctcccatggtttctgccgaaaaaatatacggtactaacgcttccccttcttcttttcttgcttcccgtcgttctaataataaagtcaggttccagtcatcgaaaactgcctgtttctcgttccaatactctgtaatataaatcacttctgaaaactgttcttttctttctttttcaaaagaatctatcgttgcattcccctgagaaaaaaacatactttgaaatacatgggcatacacttcttccaactgcattgcatttgccacattgtaaaaattccatccatcggtctttttatcccaccaacaaagacaatgcttctgtccttcctgtgccatatgctgtgaaatagaaaaaaatgcttctaacaacccgtcaatcatagcagcatccagcttttctacccttgtttcgagaaaaataagtggcatccgcatcataggaacttccacttcttttaccatatattcatctgtttttcctgttagcttccagtgaattaacttcatggaatctccatcaacatacggacggattccaaaatattcccccggaccatttccctttttaccactttgttcctcatcaaaaaaagaacaggcagctccgctgttttgtactggaaaatgcagttccgttgtttgtggcagaatcattaccaccttctcctgatttacatatgttacctttttcatacatccaaaaaagctgtacagttccacccgcaaaatcgtgatttccaaaaatcccatatattccgaatctataacaaaagcagccgcaccattttttcgtcccgctgccctgatattcatagaaaatatttccttttccccactaatcgtcttctttacctgtaaaaaaactttcccagataaaacagggaacactcctgtattgctgatacaaagtcgtccggtaattttttcttccttttgcgcataggcaggaataatcagatgagtagaaacttcttttggaagataaagattataaatgacagccaccagcaacataattcctaatgccatcccggcaatcttccctgttgttccagaaagaaaaatgactaacgcaatccacagtaacagacagacaatcccgctaattcgattcatccataatctttttcgggtcatcttcttcctcctgccgctcttcgatctggcacatgtacagtggcacaaatttcatccataatcttatccacatctttcctcgataaccttgctcttgactttaataccagacgatgacggaaaacatcttttacaacatcctgaacatcttccggcacaacataatctctgccagccaaaaatgcactcgcttttgccattctgcacaaggccagagatcctcttgggctgacacccagctgaatcatatcatgtcttcgtgtcgcatcagaaagcattgcaatatactgatagattaaagaagaaaccttaatctcattcacttccttttgcatagaaagtaattcttcttttgagataacctcattcacatcatctaatggatcactcacctttctctgactcatcagaatcatttcttcctttattgttgggtatcccatagacaaaagaaccataaaacgatccatctgcgactccggaagcatctgcgtacccgcagaaccaagcggattttgcgttgcaataacaaaaaatggttccggtatatttcttgtcacaccgtctaccgtcacctgtccttcttccataacctccaaaagtgctgactgtgttctacttgaagtacggttaatttcatctgccagcagaaggttcgtcataactgctccctgacggtattcaaactttccactctccttattataatagtagaaaccgaccacatccgatggcataacgtccggtgtaaactgtattcttcgataagaaagtcccaaagcctttgaaaaagccagcgccatagttgtctttcccacaccaggtacatcttcaagcaaaacatgtccaccagagagaatcgtcatccacaccttacggatgaccttttctttaccaataattactttattcacttcttctataatcaaattcgctttattcaaaaaatgctcctttcctgctgggacggcaaaactgaattttatacacagattactgtccattataacacgaaaaagtttttttgatatagtaatttatccgacagataaaatcaggaaaattctttaatacaatattctaaatatcacaaacaatatcacagcctttactacaagcattggtaaccatagctttccccaaaaaccattatgtgtgttttgctttggacattttccgatacattttccacaggagaaacattctccggatgtcgcattatccccttctttatccgatggtatctcaaggtttgccggacatactaaattacacgctttacaatttggaatacagttttctctgtttcgtttgattacagaaaatggtaacaccggcatcagagaaaatactgcccccattgggcataagaaacggcagaaaaatcttggttccaatgccattcctgctgtaaccaataaaaagagacctgttcctataagactgtctgccatctttaactgatgaaaacgggaaaatgcactgaacggactatgtacagcaacggcactactgtaaccttttatgcaaagaagcaggacaacaagcagtacaacatattttaaataccggagtatctttccctcttttgaaaaacatttcaacggtttcttttttctttttttgcaaaccatagatgaaataaaataaacgaaatcaccccatgttccaaatgcacaggcaaaaccacagaaaaatcgtccaaatacaatggtaaaggccagcaatacaacaagtgtctgtacaaaggaattccactgcagacttgcacgctgtgtaatttgttctacaattaattttattccggtaaatgcagtggaaaataacgctggatagatgataaaaaatactgcccgtatcatcacttctatgattgtctgcaccgatatttttttctttttcttcattatttagctgctccttctaatgcctgtcctactgcattctttattcctgtagatgaataggttgctccgcttattgtatcaacctctgtcgtctgcttatcaagtattgtcttcacaatatcttttgccattgataaataagcctcatcttccccacttgcttctataatatctatcgcactaattttcttcccggataccgttacttttactttaatttctccgccaaatccctgcgaacttccagtatatgttccatctttatacgttcctgcctgaccggcagatgcaccatcggtccctaactttccagaattttttgccgcttcaagaatatcctctttttctccttgaagctgatttacctggctttttaattctgcaattgtggcttctttatcacgactgtaaatcacagcctgatatcctgctaaaagccccagaacgagaataagatcacataaacggattaaaaagtttttatacttcattcgttgtcccttctaaaatgctttctattgtcttttataaattttcttactattttaaatattcaaataactttttcttaaataaacgcaaaagcttctcttttcaaaattacttctttgccgcattaaatgccttctgacatgcatctttaattgctttagaagaacaggtggctcctgctacagtatttacgccatctgcatttccatttgctataattttagaaatcattcctttctttgcatcgtttgtatatgctttattcgttgaatttgtatttgcggtaatgttggaaatttctgtaattttatcttttttaattgtgatatccatggaaatcgtatacggatcaaaatcctcatcttcatccggctcgcaggttatgcttactttgtatgttccatttttgtagtttttcccttcgtctggattttctgttgtttcttcttttttctctgtagtcgtttcctctttcttttccgttgttgtctcttcctttttctctgtggtcgtttcctctttcttttctgttgtcgtctcttcctttttctccgttgttgtctcttctttcttttccgtagaagaaccatttttctttgcttttgataaagcatcatttaccgcattaaaaatagcatgggaactgtatgttgctccactgacagcatctactccgcttgttccgtttttagagacaataagtgatggaagattcttaatctcatctctgctcataaactgtttcaggttggttccttttgctgtagaagaaatctccaccgcagaaatctttccatttttaatcgttacatttgccgttacactatattccttaaactgctctcccgaacaggccgcacttccggtataggtgccgtcttcatacccttctgccggtgctgcaatattattgttgttattattgctgttagaaccactgttttttttcttattttttttatttttcttctttttctttttcgtactgctttttcctgtttctgcctttgaaagagcatttcttactgcggtaataattccattggaactataggttgctccggatgccacatccacatttgtagtctgtccgctgatcatctttgggataattccttttgccttactaaaataggaagcagtttctcctgatgcgcttgttacatcgatcgcgctgatttttccatcttttactgttacttttacagaaatagttccaccaaatcctttgcccgaaccagtgtaagttccatccttccatgtaccggattcacttactttagaaacactcggagccgaaccacctgcattacctgcgttcgctgctgccgctgtcgcattattagactccgttccaaaaagtgcattttttactgcaccgataattccatttgaactgtatgttgctccggacacgacatctacatctgtactctgtgccgtaagcatctcatcaataaccccttttgcacgctgaaagaaagaatccgtctcacctggagcactgacaacatcaatcgctgtcatcgtctttttgcttacagtaacatttactgtaacttttccgccatatccgtttgcagaacctttatacgttccatcttttacatcaatagcccccttctttcccttctttgttgtattctttttcgttgtttctgccgttgctgccctactttccttcgcaagcgcttccttaatctgactgatgtcttctgtctctgaagcttcatacttttttgcctgtggggttttgtatccggtaagtactgtcaccataagaaccgccaggcaaaccgccggaattatcgctgtaattcctttcacacctgaaaccttatcaccaagacttttaaatttttcaacatattttttccacttttctctcatcatatctccctttctttttgaatgtattcttgtattcctgtactcttgtattcttatattctcgaaatctttttgtacttgattttatgagaaattttttgtatcattatttttttattatcgtaaaatcagactcactggtaaaatactctgcgagtccctctgaaactagaatgcttccgtcatcttttacaagaatcgtgtcaaactcatcactgtgttctttccagtatttctgtgctttttccggtcccataatgaataatgatgtggacaaaccgtctgcaagtgttccgtcatctgatacgatcgtaacagaagtcagaccattatttgccggatatccattagccggatcaataatatgatgatatgtttttccatcctgcttaaaataacgctcatatcccccagaagtaatcactgccttatcctttatagaaagcactccaatataacttcccgtatctgccggattctcaaccgccactctccagtcagaaccatctggctttccgtttagtgtctgcacattaccgccaagactgatcactgcactagaaatcccattttctttaaaaatatccattacttttgaagaagtatatcctttcgcaattccaccaaggtcaatcttcattccttccttatttaaagtgacctcctgttttttctcatcatataaaacgtgatctgctcccatcagtccccttaacttcttcagctctttctttcctggaacacgatagttctccgtcgggaatccccacgcctgcataatcggataaatcgtaatgtcaaacactccattcgtgctgtcataaatctcttttgaacgcttgatcagatatcctgttgtttctgataccgaaccttttccattcttattaatctgcgaaacttcactgctgtcaattcccgtagaaacaagctgttcaatattgttaatctcatcaaccgccgcatctaatgctttcttggcatttttcccgtaagccgttaaagtcatatacgtatccatcgcaaaaatatctcgtgattccgattcgtcctcttcgttttgggacttacgatctgtatccacttctgcctgtgttgtctgctccacagcctttctactatcattcttacttttctctgtatctcctgatgttccacatccggaaagcattcctgcagtgaacacagtggtcagtaacatcacaactgctttttttctaaaatttatcacaacaatcctccattatcttgaaacttacttttattagttctttctaactttatacattatatagaaaatattctgacaatgcaatttttttataaataaatgagaacttttttcattaatatatatacagtttgacacagctaataatagtatactattatatttttcgttagaataagctaactcaaataccaattataatataaggaggaacttatgagaaacaaattacttgtagcaggtactcttgctcttgcaatgacttgtactactgtattttccagtattactccagcagttgtaaaagcagcaagtgtatctacagtacagacacagacagcagaaaatagtgatgactacgtttactgctatgcaggcctgacatgggctgaatattggaaggctgaaggagtttgggcagccggagataccacttcttctgatacagctgattcacacggtgaaaaagataaaggtgcctttgatgctgtaacaagagctaccgctaatcacggtcttcatcgcggaagttatcagtgtactgcgattattgaaggtgaaaagggaacttataatatatctcactggacagatgctaatactgcaatcctcactaatggagaaaaaatcacctttactaggggcgcaatcaaaaccagtgatggcactgaagatactatgaaagattataaagtttatggtcttaaatatgtacctgttgcagtaaagtcttctgattttgaagctttcaaagcaaaatattccgttgtagaaaataacggtaccttaattggcggctatggagaaaaaaatctacaggcttataacaacgttactgcatctgttgataaggataccaatggcctaaagactgccgaaaagcagagtgatggttccttcacatttacccaaagaagtaacggctcttcttctggtattaaagataagactcttaaaactgctgatttaaacaatatgggagcaactgtaaaggatgcaagcggtagctacggtgaatttcttcgtgtagatttcacaaaaaattacggcgatcttggcgctaatatgcaggctgtaaaatggacctactatggaaatgacagcacacgttctaaggcacttgccacttacggaacaaagtttgctgctgataactggatgcataaaagtatgggaatccagttaggtcttacaaattctattcgctgccagcttccaaaaggatatgacggaactggctactggagtttaaccatttatgctcttggatacgctgattctacatataactttgaagctactgatgcaaacattgtaaaacctgacacaaatgctggcgatacaactgagttaaacaaacttgtttcttctgtggaagagttaaagaaatcagattatacagaaaaaagctggaatagcttcgaaacagaattaaatgaagcaaaagacattttagcaaaagagactcctactcaggcagaaatcaatgaagcagttgaacatcttacagccgctaaaaatgctcttgataaatatgaatacggaacagcgaatctttcttatgcagacttctattacggagaattaaatgacgtaaaagaggatactactttagacctcacttctgataaagccgcttcttatcgtgaaagtggtatgtatgatgcagtaagtagtgcaacaactaataaatataaatctttcttctccagtacgtattcagaagataatgcaaacggacagggtggctctattatcggtatgaaagacgtaaatatcgctgttccaacttcattatatgaaaatgcgaaaaaggctatttccgaaaacaaagaatgcagcaacaaattattggaaattattggttctatgaaattatctgataatgcaccatctgaatataaaatcttaaatggtgatggtactttgacagctatgaaatctgaggttaccgaagatacttctgatacacttactatcaaaacacagtcttcctacggacaatatgaagtagatcctgtaacttctgaaaacagccctctttctaatttaagtgctaaagattccttacttggtatcatcgttgaagacgaagatggcaagaaatacggtatggagcatctggaaaacatctggattggaggcaaattctcctttgccgtaacagatggatttaaagaaaagcatggaaacacaattgattataatcgtcatgaagctttacaaggtaaaacaattaaaaaagttacttatcttgtaaaaaacggtgctgatattgttattaatactaacttaaaatgtaaaactttagctggttctgacagcattaaagctaccgctaatgataactttaaagatggtgcaaccgtttctgttgatactactgctgttccttctggttctaattatactttaagcagcgtaagtatgggaaaaactgtcctgacagaaggtacagattatacatacgcaaacaatactctgacgataaaagctacagataatactggtgtgggttcctattctatggtatttacagatgatacttactctgatattgtagcctccttcacattagaatctggctacaagactggagatatctccattaataaaaataatcaggttactcttcctgccggtgtcaactttaaaaaatatgtaaataatattacatctattaaaattaatggggtagaaaaaacaggaaaaggcggaattaaagctactgatttatttgatgcagacggaaacattaacttcaatgcagcaattaaaggtaaagatggttcttccacacctgtatttgcagacaaatctgcttcttacacaatagagcttacatcaaccggttacccatctgtatctggaactgtacagctgaatacttctatccttgaagcttccatcaaaaaagcagaagcacttgatagcagcaaatatactgctgaaacctggaaagcacttcagactgctttaacagaagcaaaagaagcaaaatccgctaacacacaggcaattgttgatgctgcaaacacaaaacttacagaagctctttcaggcttaaaagaaaaagctgttactccttctaaacctgcaacgccttctaacccagacacaacaacaactaaaaaacctgctactaaaccagcattaaagaaatcaaacgtaaaactttccaaacctgttcttaaagttggaaaaacaacaaagaacaaagcaaaagttacatggaaaaaagttaagaaggctaccggttatgaaatccagtacacaacaaaaggattcggtaacaaaaaagatacaaaaacaattaaagtttccaaggctaagatcacatctgctcagcttaagaaactgaaaaagaaaacaagatataaagtccgcatccgcgccgtatatacaaaagccggatatcagtcagctacatcaaaatggtctgcaataaaaactgtgaagacaaaataataattgtagatttcgtgtagacgaaaaaagaaacgaaaattagtatttaagcattcccttttttgagaacttttttcatttggtattttttgtttgacacaactaattttatatagtattctctaattgcgagatatattttctatctcagacttacaagatttgaattgaattttcggtgcttaatatctttttattagatattcatgcatgaaaacctggtaggggaccctccactaacgcactccgtatgcgcgctagggagagttctctaattttttgccttaaaaatcagtgcacagatttttatatatttattttcttatcaaatatgtccttttggaattttttatgtttgatttcataatcaggttctaaaagtatacaagagaagaagggagactacaaatttaatgagaaaacaaaaattattaactaaggctctggcagcttctatggcagtatttatgtctgtcagccagctttctgttcctgcatttgcagcagaaggaacaaaatccgtttctatcgcaggcagcacttacacatattctgcagaagctttagaaggctatactcagattggaaacagtggattatattataaattaactaacggtacaggtttttccggaacgatatatggaacatctaatttaacttacaaagaattttattctggtgacgtaagcagcacagacagctttgatgtcgttactactgccagcacttctaagtattctgttttatctaatgcctggacagattataagaaggaaagtgcagaagctgcaggggatatcatgtaaaaggtgttgcgaatgtaaatattgctgttgattctgacctttatgttgaatctattattttaaaagatgcaaacaaagaattaagcaaagcatatgaggaagcttctgatattacattaaatgaaaatcctacacaggttccttctcagtataaaatacttcaggaaaacggttcttatgtttctaataacaagacagtcgctactgtaactgatgccgtaccaacattaacaacaggatccacctggggtgaatacgagattgatgtggtggaaacaagcacaaaatacttaagaaattcccgacaagatgagggattccctgtcaattctactattcagggaatcattcttgaaacaacagaaggatataaagtaggtctggaacatctttcaaatatctgggtacaaccttataaattatcttttaatgttgccaatgaagcagctactatgggaattgcaaaatcagataatacggctgaatttgcaaagcttgtcaataaaacaattaataagattacttatgtaacaccagaaggtaactatgtttatactttcgctgatggaatctttataaaaccagcttactctgaagaaatcagcggtactttcagtgacgatatgaaatcatttactttaaatcagcttcctactgtaaaaaacggaacattaactgtaacatatactgttggagcaggtcatatgaagactccttatactctgtattccggagctattgcaaaaagcgtttctcttgacttaaatgctatcccatctgatgcagaaggtggaacttacagcgttgctatttcttgtgataactacgctgatatccacgttgcaatccctgtaacagaagctcaaaaagcacagttacaggaacttatcaaacaggctgaaactgcattaaaaggtgccggtgctgatgatagtgtattattagcacataaaaatgaggcagcagaactcttagcaaacgaaagttctaccagtgccgatgctgctgatttaatcaatgaacttactgaattattaaaaccatatcaatccacagaagctccaacaccatccataccggacagtacaacagcttctaaaccaaatacaacaactgctgctaaaccagctacaaaacctgctactacagcaaagaagccaaacacaacagccacaaaagtaaaacttgcaaaacagactacaaaagtaaaagcaaatggaaagaaaaaaatcaaagtatcctggaaaaaagataaaaaagcttccggttacgaaatcacatattccacaaagaaatctttcaaaggaaagaaaacaattgtagtaaagagtaacaagacaacaagcaaagtagtaaagaaattaacatctaaaaagaaatactttgtaaaagtacgctcctacaagcaggttggaaagactaagacttatggggcatacagcaaagtgaaaactgtgaaagtaaaataagtttctcttaaacattttatataattggtatttttataaatagtattttgcctcaggcagggagagacgctcccggagaaagtagaataatagttgcctctgcaaatgtgagaagtaataaccatatcttctggtttatacattctattatttcttactattcaaactctatttagtaaaaaccccacgaagctatattccgtggggtcttttttattatttgaataggattggcttagattataaataattctcatacttcttaacacacccgattccaatcgcatatggtccggtatgtaccgcaatggttgccccaatctggcagattcccacctgatctacatggctctctccatagatatggttcgcaacggtattataatattccttgccttcctctatatcgtaaccaaaaccaacgcggaaagaatagtcttccatcgcatctccggtttctttaaaatagtcatccattaacgcaatcgttttggcaactgtcttcttacggcttcgtccgattcctgaagcttcgatctcaccatttactaaagtaatcagaggctttaaggaaagggcgctgcttgcgattcctgcaagctttccgattcgtccgccatgttttaaataatctgtgttaccgactgtaaagaagattctattcgtctttttcatcttctcaagaatatctacacattgttcataaggaactccattctgacacattcttcctgcttcaataaccataagaccctgacttactgttcctgcttcagaattaatcaccgcaattttggcatccggataatcctcacaaacaatttctctggcattacatgcacagttgtaagaaccactcaaagatggagtaaaacaaatacagactaccggtgttccttctttcacatattccgtaaaaacgtcaatataattctgtacagatggaagagaggtcttcggatatacatctggattccctaccattcgctcatatacttcacgaattccgatttcttcaatctctttataatatgtctcctcatcaaatgatatataaaaaggtataatacgtaaattatactgttcaatgatctctttttctaaatcacaacagccatcactaataatcttgtaatccatttcatcctccagtatgcattattatattactatacacagaaattaatacactgtaaatatcactcaaaatgaagcattctctcttactgcaatgcaatctgtgttctcatttccatgtaatgtagttttcatatctatattttaatattatcaaaactctttgtcaactatcttctctatatagtctccggtaaattccagattctatggctgtcttgataatttatttcatttccttttccagaaattttaccactcccgcattcagattggtatctaaaatatagtctgccctttcttttacttccttatgtgcatttcctaccgcacaggaacgatcacaagcttcaaataaaggaatatcattcagattatcacccattccggtaatcgcggccggatgaagaagctttcgcagcttctgtattccataatattttgaagcatttttatgcgagatttctaaataccacagaccatctccataaacatccttataaaaattcagattcagccgctcatcttttttcaaatattcataaaatggccgtaacacttcttcttcataacaaatggaaaaataaatgatatcttcacctgaaatatcttctaatctttccactttactaaatggcttatggtataaatctcttcgttccgtataaaacttttccatatgctgtgtcgcaattttttcataataggttgccatctttcgtccagacttgccgactcgtccggcactatctacaacagatgtttcgccagactttgagcaatcttcggaaatttcaggggacagtgcatatgcaaatcctgtcactccaaacttctttcttccttttaaaatatattccacagaatctctttcaataatttccgcatgaatacagctttttttcaccggatcgtaaatcatgactccattcatcaaaatcataggacaggtgagattgacatctttcataatagaattcacagttgcataggttctcgctgtagcaacagtaaaacaaagtccctgctcaataagagcatttaatcgtttaggcacgtcttcgttaagtaaggcatcactatttaataatgtgccatctaaatccgatacatatagcattttgccagaaagattatattctttcttctcctgctttcttaaaacttcttttgatacattttttcgtatctcttctggcttttctttttgcatcttatctgcttttacttccaagcaggcacgtttttctgcttcctcacgaactctgaaaaaaagatactgctgcatcacaccagctatcccttcatatctttctactggaaaatgcccgttataatacattttttccactttggcaatccatgtatcaatcggaaataaggaaagctgatgtaaaccaaaaagctgaatacaagatgctaccttttctcccactccatgaagttttttcagcatctcctttccctcttccggcgatgccccttttgcaacggctgtttgaagtacactcagttcaaacttcccagttaaaatatcctctgctgtctgccgaatatacttctcccggtatccaaacttaaactccgacaaatcggcctttgcaagcacttctggtcccggaaaactataaccaataagatgctcctcttcataattaaatactattttttctccaagtttctcacataatgcatcaatactcttcataatacgtggaatattatttctctgactgatgataaaactaacaatcatctcccacagatcctgacgaagaatccgaatcccttttcccatcttcgccgctccagaaagaaaacgatcttccggatcaatctgttctattattttctcgtaatctgtatctaaatccaaatactttctaaaatattcctcatccttctcatgacacaaaatacggattcctgtcttttcctgaaaaaaacatgccgtccgtccatcagaaataacaaaatatcttcccggacatattttcttccagcggaagcactgtccactctctgcaatctgctttaaatctatataatcgttttttataaaaatatcaatataatccatcggtggtttcctctttcgaaaatttctactcccatcttaacaggttttagggtaacattcaaaggaaataaatctttcggttctctgcggtttgggagacggaaatcagccttttcaaaaaaatcaaaatattttcaaaaaagtgagagattctcatcccttatttgcgaatatataatgtaaccgatataattatccatatattttttacattcgaatgtacataaaggagtaacctatgaagataaaagaatcgaattttgtggaagcgttatcccacagaaatgagagagctttagaatatgtgatggtacattatggtggacttgtaaagtctgttgtgcatcgttatctgaatgttctttctcaatacgaagaggaatgtatgaatgacgttttcttcgctgtatgggaacatatcgactcatatgactccgcccgtaatccatttgcaaactggattggcggaattgcccgattaaaagctcttgattataaaagaaaatacgcaaatcatcttttggaaacaagctgggaaaatgcgcaatatactaaaggattggacgatgcaatagaattacacacacaatttgaagaagaattttctgaagaaacaaagcaaatgttatcctgcctaaaaccacaagatagagagcttttcatcaaactatatgtagaagaaaaaccatttgatgagatatccaaagaaatgaatacaaacaagcctgtactgtataatcggcttttccgcagtaaaaagaagctgcgttctcttttccctcaaacaaattcaactcatctgactggaggtacgagttatgaaaaatgatatttatgatttattaaatgacattgacaatcagatagatacttttgaaactgtcgatattacaagtactgatttaaaaaactggaaacaatcttttgctttaaagaaaaaaacttccgttaaaaaacacacctggaaaaaatatgctgctgccgcagctgcctttattattcttcttggtggaagcagtgctccggtaaggcagaacgtatacgcacaatcccaacagattatggaaagtttatccacacttttaggcaccaaagaagaccttagtccttacagtactgtcgttggtaaatctatatccaaaaacggcatcactatcacattaaatgaagtaattcttgatggacatagccttatcatttcctacaaaacaaaaataaaagacagttctgtattgaaaaaatcaaatatcaaaactatcactgaattgccaattgatatagaccttactatcgctggagaacctattgtagaaagtgtcggcatctgttctactcctatcgacaagctaacttctatttctgaaagtgaaatacaattaaatgattcctccattttatcagagaaagctgattttacgatcaacttttccacattagataaatcaaatacctctattggaaaattaaaatttgcggcatccggtaaagaattaaatgcaaaaacaacaaacgtagcattaaatcattcttttaccttaccaaataaaacaaaaataactttaaaaaattatagaagtaatatcgtaaaccatcaaatctcatttactatttcaaaaaataatactggactctctggggacattatattgaaaggaaaagatgaccttggaaaccctgtagaattctaccttgataccgccgatggaacaaatggtacttttacagtagacagaatgaccggctatatttcccctaaagccacctgcctcactttaactccatattataatgactttcctctgtcttcctctgttaatagtacagaagaaacggcagaatccactgaaaaaacagtagcagaatctactgaaattgaagtcagcaccacaaacactgatgatgctcaggaaatctctatctctaactataaatcactaggaaaggcttttactattactattcattagagaaaacagacgaaaaaagaaataataccatagtaaatgtaatgtgagagcaagtaaaaatgccggacagacattttctacgcagtgatatctttacatttactatggtctattctttttattttcgtctgtttcccctaatgaatcaaatagttaattcatgattttcattcatctggataaaccgggttccaagctctttcgcaagctgattattatgggtaatgataattagtgttttccctgctgcatgaaatttcttcagaaaatctataagcattttctgtgtactttcatcgagtccagcgaggggttcgtctaatataagaacttcgggattcatagaaaggatgcacgctaatgatacttttcgtttttctccaccgcttaaatgatacggtgggcgttctcttagtttttcgattccaaataaacgaaggcaatcctctgttctttgtttgactttttcttcggaaagtcccatctggatcgggccaaatgcgatttcttcttctacgcttccacaaaaaagctgtgtatctgcattttgaaaaacataacccatctgctgatgaaaccatttggcaaagcgagaatcttttaatgctttttctgttatttcgtgatcttcataggtataactgccttccatcggaaatatgattccgttcaatatttttatcaatgtagatttaccacatccatttggtccctgtattattacagattcacctttttgaatatttaaattaatgtatcgtaatgcaatttcattcccatatgcataacatacattttttaattctatcattttgaatcttccttttatttttgttattcttgattttacttttgttattcttgattttactttttattctcttctcatagaaaattgctatatgttaggattaaaaggtcttttaccctctttgatactagattgattgcttcgtgttatttccacagaccctcgaaataaatgaatattcctgttactcctatcatcaaaagaagactcaagatatcctgttttcgaaaggtagatgttttttgtgttttatattctccaacaaatccacggcagcacatcgctgcatacatttcctctgccatttctcttgattttaaaaaggaaatccccaatatcccagaaaaggactgtgcttttttcctgttttgtcctacagatcgtaagcgaagtgacgtaaggatttccatgcagatttctccgagtacggcaatatattttaatgtaatatccaatgtaaaaataaagatatccggtatatgaaatgagcggaggcttgctgttaatttattccaggatgttcccgctgacagaatacctataagcgtaacggatacaaacactttggttgtgataataagcaaaatctgcggatttcctataaacactgccggtaaaagtattagtgcagaaaaaagtactgctccaaatgtccccgaaagtatctgtttcattgtttctgccggataagttgcaagtgcaagaatagttccgcctgccataattaatgaaaatacatagttttttgaacaggcagtaagtaaaatatataggaatgtataacatagttttaaagaaggactggcgcttaggcacccgtccttcccttctttccattttaattttgacagtacaccaagaactgcctgcgtactttttgtaataaatccatctttatcaatactcggaacatattgctccgtttcacacatccatgatggaagaaaactattatttttttcctgattttgcattacactgactgcccttttgaaaaatctattttatcttttttacttccagctaaaagtttaaagaagataacaataatcgctacgccaacaactgcagataaaatatatcctatccattccggcattcctgccatagagtaatccgggaaaagtgaagcaaggctaaagcccttttccattcctgccggtgtatatccaagtgcttttccattacttacaagggatgccatctcttcaacgccccattctccccaggcggttccacttgccagaagacctaatggtgtgaatataatcaaaactgccataagaatatataatggcttaaatgcggactgtgctggtttttcctctaatgtttccggtgatatcttttccacaaatgcaaggattgctgtagtaagaactatttctgcaattccaaataatgtaagatgtccaatcatcattgccggaatagaaatagtaagcggatatggacaatagagtgcctttcctgctgcatcagtaaacagcaatggctgaattccaaactcaatcgctgcacaaaatgctgctgcattaatgccgatgtaggaaccaattcctgctgctaactttctttttcctgttttttcccagataagcttgtaaatcgcaaatccgagaaatggcaatatgaaagccatattaaaacagttcgctccaaaagcgagaataccgccatcaccaaacaacaatgcctgaataagcagtgcgatcgtaacggcaatacagcctgccgatggacttcccgtaagaatcgcaatcaatgttcctcctactgcatgtcctgtcgtacctcccggaagcgggatattgaacatcattccaagaaaagaaaacgctgctccaattccaagcaatggcatcttcaccttcggaatttcttcttttactttcttaacagagtatgtccataccgaaaccattgctgcggccattaccgcacaggtcgaaggactcaaataattttcaggtatatgcatctttctttcctcctataaagcttttatgttttaaacctaggatatacctttctattttttctcacaagctccccagggggatatattttgtatttttttgtataattctgctataactttatgctatactattatactgatactgaagattgagcagcttctcgactgaaataaaaattctgaggtgaattttatgaatactctattagaacaaattaaaaagaaaaatgcaaaagcttttacacatagtggaaaatttcatgcagacgatgttttctcctatgcactgttgttatatttaaatcctgcaatcacaattacccgaggaaataaagttccaaaagattttgatggaatcgtttttgatattggcaggggaaaatacgaccatcaccagcgcgacagccgtatccgtgaaaatggtgttccttatgctgcatttggtcttttatgggaagaacttggtgcagaaattcttggcgaagaacttgccgcaaagttcgatgagtcatttatccagccacttgatattaacgacaataccggcgagaaaaatgaacttgccactttaattggcaattttaatccttcctgggatgtggaaaatggagaaaatgaagcattttccagagcggtacagacagctggaatgattcttgtaaatatgttcgaaaaatataaaggaaatgaacgtgccgagaaacgtgtagaagaaattttagccgcacataattcttctgttttgtctggggaaaaatctgaaatcgaagcaaaaattctcgttctccctgaattcgtcccatgccagaaacaattacgcgaaacagatattgcctttattattttcccctcaaaccgcggaggctattgcatccagccattaaaaaaagaacattctctcaattacaaatgcagcttccctgaaaactggcttggtttagagagagacgaattaaaacaggcaactggcttaaccagcgcaaacttctgccacaaaggcggttttatcatgaccgtcgatgatgtaaacgatgcaatttctgcctgcaaaataagccttgaaaactttacagaaacttcttgcattataaatttgggaggttcttccaaaatggatgaaatccttaaagaaatccctcatatggaaaatgcagcaattatccattgtgacttaccgaaaatgcccgcacttacatttgacagaaacttgggtgagatttctatggaaaaagaggagtttgcatcttatattaaagactatgtgaaaggcattttaaaatataaaccagatgctgtttacgttgaaggagaacttttcattgtctatcctgtcatccgggttttacacaaaaaacatatcccagtctacataaaacaccaaaatagggttgttgctatttaattcattaagggacagacgcccgagaagagatacgatatcctatatttgtgactttagtcgctgcggtttggatgtgagcgcatgagcgaacatttaaaccgcagcgactaaaatcacaaatatgccttattgggggcaatgccttcgtctgtagttcgcttaatgaattaaatagcaatattttgtactgtttgaatattcttctttgtatttatatccaagttcatcgaactgtttaatttcctctggattttctatctgatgttctgccatatagcgtacaagggaacctcttgccatttttgcgtaggttcctttttcttttatttttccatcgatcagttctccaaatacacaggttataactcgtacattttcagggatatattttaaaatgcttttgctgtattctttggaggcaaggttaatgagacaatcgcagtcttttaagacgtagtctgccagtttttgtccccaaaagtcatataaattatctatttcttctttgtggaagcgtgcctgcatttcaaggcgatatggaattactccgtcaaatggagatagtgcaccgtaaaagcctgataaaatccgtaaatgtttttctaaccatgtaaaagcctgctcctcaaatactgctggagccatatatttatactggattccttcataggaaagaatcgccgggcttagattctgttttaagtttcctattcgaaactgtcgctcattctcttccacaagcttatcactgcatttccacaaatcttttagctcatcaaatgacatatttcccatgtaagaaaaaagcttctctgcttcttttataaaaaatgggatatttttatacggtaaaatatcgtttcttattttcatttttttcgctggggaaataattacttttaacatttggatttcttcctcttactttcctattttttatttgtccatttacagattctgaatttgtatatttttcgtaacataccagtgtttcttccttctagcttctaaagtattgttggatatagtttgattcgtgactcttttgttgtaactgccaaatgattgtccataaactattattactaaacagctaatacactatcctataccagaattttttcaaacactccttgaatcccttagaaaatttaactttacaaatttattgttataaaagaactatactatatatctagtgacatgctcccaccacttaaatcatagattttgaagtgggggcttcttgctcaatggctctactgagccaagtatctacaagctatcctcgcgtgccccgcgattcttttgcccggatacgggcatatttcttattatcagcttgtccggatacggacagtttatgctgtcaacatccttcttgcttcttcacgtatgttgattgccgcattacgatctctgtccatcttatttccacacgcacagtgataggctctttcggataatttcagctctttctttatccttccacatttacagcattttttactagaaggaaagaaacggtctacctttaccattttctttcctttccatgccagcttatagtctaacatttccctgaacattccatatccattatcctgtacgctttttccgaaatgcaggcactgacccattgctttcatatcgatatcttccactgcagccgcatcataaccgtctgcaatctttcggctaagtttgtgtagatgatctcttcgctgatttcgtatcttttcatgacatctggcaactttctttttctgcagttcataattatgacttccccgtacgcatcttgacaactttcgctgttccctcgccagtcttttttcattttttctaaaaaatcctgcttcttccgtctcaaccttttctgaaaacactgccattccctgcattgcataatcaatcccaagtatctttgcagtactgtaatccggtccagcagcttggttttcacagctgtatccttcataaagcaggcttgcaaagtattttccggatgattccatactgactgtcactgatttcaggcgaaggccttctgctggctccctgtgttttttcatggcgatccattttaatttaggaagccggatccgcttactttccaccaggatatttccattaaccacattcgttgtatagctgtttttggaatgatgttttgacttaaaccttggaaatccaatcttgggatcccgaaaaaaattcttataggccttttccagatgaagctggacatttgccagcgccagcgaatctatttccttcagaaatggatattcctttttatacatggccggtgtgttttttaacattttcttcgtcttttcatactcccggatcttatcattgagcatctgattatacagaaaacgacaacagccaaatgttttgccaagaagtatcttctgttcttctgtcggataaattcggaaacgatatgctatgttcaatactttttccctccttgggtttcaatgtcttgatggattacttctaccagattccctcctgctgtcagcagggcagaaactctgactccaaaaggcttctttccaaagcttttccctgatttccggatactcctttttcaatagtctgctactggcactttttcaggcattgataaatttactaagttccgttctcgactgtgcatggaacattacatacacatgatcaatgtcattattccattcttccagaataatcccataccctgaagcaatatgttcccatattccttttgccctttctgaaattggattatcaatgacttttcttcgatatctcactaccatgatcagatgatagtacatcagatatactgaatgcacattatgatttatttttccttttctactgactctattataccatggattgcattattgaacaagtgttctctttttatttttacgcaattcatctcccacctgcagaggaaggagaattcttgctatattatgttaaaatttctattttgtgttgttttttgtctgttttctaatgatatttcttcttcatcaagtaaagtttttacgtctttatgtaaaatatatttgacatcgcaatttttgtgtgttatatataaatcatacaaaagagtgtcataaaatggtatcttacagcttcactacatatcagttattatgagcctcttttcgtatttccattttgtttttcaatttactaatgcaaaaatttaaggaggttttattatgccattttcattactagctcttattatttttctcattgtttatgctattattgcatacggtgtttattcttcaagaaaaatgcaatacgatgagcggcaaaaatatatgcagagcattgcctacaagtacggtttttttactctcattcttgcaactgcagtcaatggtttcatagaatattatacaaaatcatcctggggtactccattagcagaatcatttaccattatttgcatcggtcttatcgtattttttaccatttgtgtttttaaagatgcttatttttcttattctgaaacaccggtaaaaaatatcgttcaaagcattttccttttttcattaattggtggaataaatctttatactggtatcatgaatcagcaagaaattatctcacaacatagccctgttaaattcaataatatcaatctgatttcagggattctactattacttgccgatgctattgttattacccgcgctattatggaacatctgcaaaaagaggagtagccttatgaaaaacctacgattaaaagctgcccgcgctgctcttgatatgtcgcaggctgaacttgcgaaacgtgttaatgtgtcgagacagactattgttgcgattgaaaaaggggactataaccctacgattaaactgtgcattgctatttgccatgaactggggaaaacactcgacgaattgttttgggaatggtaagccgctgtagatactattctatcggattgttcaaaaaatacgaaaaagaagaactaaaaaatttaccccattttatgactttgtgctgcggaattttgaccatagaaacttcggactgctttttccgaagtttctgctttactgggcaaaatggagcgtttagcacaacagaataaaatggggtaaattttttagtgcttcttctcgataatccttctagcaatccgactacagatttctccgacagcggcgtcaactttgccattcggcaactcagtaagttattgacttattcttttttgtctactacaatagtgctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctagtgttatggtactaaatcagtatgtttcaggagaagctatttttctgaaatagatttttttaatgtatccgcattactacattacagattggagaaagatatgaataacgttattgagatgacacatccgcttatcaagcacaaaatttctattttaagagataagaataccggaacaaatgaattccgtaaattaatcgaagagattggtatcttaatgggatatgaggctttaagagacctcccattagaagatgttgagattgaaacaccaatcgaaacttgcaaaacacctatgatttccggtaagaagcttgctatcgttcctattcttcgtgctggtcttggtatggtaaatggtatccttgctcttgttccatctgcgaaggttggtcacatcggtttataccgtgacgaggagactcatgaacctcatgaatattactgtaaactgccagacccaattgaccaaagacttatcgttgtattagacccaatgcttgctactggtggttctgctatcgctgccatcaactttatcaaagagcatggtggaaagaatattaagtttatgtctattattgctgctcctgaaggagtagaacgtcttgcaaaagctcatccagatgtacagatttactgtggtaacatcgaccgtcagttaaatgaggatgcttacatctgccctggacttggagatgccggagatagaattttcggaacaaaataatgttaatgaaaaataaaaaggcttattattacaaatgtggctttcaccgctgcgaataagtatttaacaaacatcctctccgtgtaataattaattttgactccattgtaaaaaacatcaaagtcgcaaaattaattatcacacggagaggatgttactgatgtttgaaaatatttgaggactctctattttaagaaagggaagtattatgttagaaaaattctttaagttatccgaaaatcacacggatgcgaagacggaaattctggctggtattacgacatttatgacaatggcatatattttggcggttaatccaagtattatggctgctaccggtatggattccggtgctgtatttactgcgactgctcttgctgcttttatcggaactttgctgatggcgattttcgcgaactatccatttgctctggcaccgggtatgggactgaatgcatactttgcctatactgttgtaatcggtatgggatatacctggcagtatgcactaactgctgtatttgcagaaggtatcatttttattcttctttctcttacaaatgtgcgtgaggcgatttttaatgcaattccgatgaatctgaaatctgccgttagtgtgggaattggtctttttattgcatttgttggtttacagaatgcacatatcgttgtgggcggttctacattactccagttattttctgtagatgcatacaataaagcgaatggtgtggaagcttcttttaacaatgtcggaattacggtaattcttgcattggcaggtattatcattaccggaattttagttgttaaaaatattaagggaaatatcctctggggtattttaatcacatggggacttggaatcatttgccagtttgcaggactttatgtaccgaatgcagatttaggattctacagtcttttacctgactttagcaaagggctttctattccaagtcttactcctatctttggaaagcttcagtttaagggaattttctctgtagactttatcgtaattttatttgcatttttatttgttgacctttttgatacaatcggaacacttgttggtgtatctgccaaagcagatatgttagatgaagaaggaaagcttcctcatattaaaggagcacttcttgctgatgctgtagcgactacttttggtgcaatcctcggaacttctaccactactacttttgtggaaagtgcttctggagtatccgaaggaggaagaacaggtcttactgctgttacaacagcgatcctttttggattatctctgttcttatcaccaatcttccttgcgattccatcttttgctaccgcacctgctttagtaattgttggattatatatgcttagtaatgttacaaacattaactttactgatatgtccgaggctatccctgcttacgtatgtatcattgcaatgccattcttctatagcatctctgagggtatctctatgggaattatttcttatgtagtgattaaccttattactggagaggcaaaagacaagaagatcagtgcattgatgtatgtattggcaatactgttcatcttaaaatacatttttctgtaatttttaaattttctaaagcgtgtttgaaaaattatggggctgtcgcaccaaaaacagccctaccctatggcagggattcatgcattgcaaatacatgaatcccctccattcgccacgcccgatgccaaaagctgtttttgtttccctagtctgtggcaaagcaaaaatgaaccatatctattccaacagggatattgaaactgcctgatcttttcgtctatcacattttttttgcgcaattttctacttttcctacctgtgttccataccatattgttccatcatcttcacatatgcttcctcctctgcctgtaatgcatccccatttgcccagaaggacagagcaaatatagaaatacaaaatagtataactgtgcttagaattcttatgattccatatttgtacgcttttttatcaaagagttctagaaatccttgtgcggtcaaatacccgacaaggaatcctgctgtatttgcaatcaggtcatcaacttcagggagtcttcctgtaaatgcctgaaagatttcgataaaatacattgcttagcctcccagattccatctataatatagctaatatagctgctcatactcacctcccacatttgaataaatgaaattactcctttaataattgctgcaattcatcatctgtacaaatagaatagcaatatatgctatttcctccatttttatttttataatttacctgaatttccatgtttccatttattacggttattcccggaacattttccatctgctgaagaacgagtttcttttttagtttattaattcgttttttatctgttattccatatctgatattttctccggtacttccatcatatccttcaaccccaatactactgatatctaagttatctattgtctggttgacagcacagcctttttgtgctaaaaatgcaagcgtctttttaaaagatggataaatataatacgtatcctgtgttgcattttcacttcccattgttccacctattgatatatctatatttcctacgggaactgttttttgtacatctgtgtagcttaagctgtctagttcacttaaataagtatcaaggaactgttttttctcttcttttgtaaggtttaaatattctgtttctatccctgaccaggttatttctttgatatcattataatctcgtgtataaagagaatagatattctttttaaattctcttgtcgcatacagtttattataaagttcttttgccttttgggaacgaaggatatagtttcttactttacgatttccgtttttcatacaaaatgttgtagaaatctcaatatcatctctcatcacttcttttttagatacagatgaaaagaataaaaacttgctgtttttctcataatactctgaagaggatgtttctgcattgttttttacttctactgattctttgattacggaaagagcaagctgtttttcttctccatttaatcctgatcgttcttccccttttccccaatatccgtaactattcactcctaatggctttatttcgatactatctaccctggatgcttttggtatatacctgtcatatccaaaaagatctgcactaaagcttgccatgataaataaggaaccaaacatgataactataagttgttttttatgacaaaaaatcgctcttacatcaaattcataaatgcattcaattaatgcatgtataacgaacacaccaaatacaactccgaatataagccagaaaatgtatcttgcatttcccaatgaatagaaaataattcctgaatataaggcagatgggataactaataacactttaattactgtatttgcctttgtaaatgccatagcccgtcctgcactttctgccggccgtctattatagagtgtgcggcacagtacatataaaccgacaatccataaaagaagaatcatcatatattttatctgcgtttctctgccgctatttatatctgccattccccgaagtccgacccataccggagaaagatagctggttatattattataaacattatctgccgtattcccggaataggtggcgaaaaaagagcccgcatatattggaaaaatgttataaataacaattggaaaatagcttgcaaatactccaaatcctaatataccaacgataatattccctgtcataatcattgccagagccatcgtcagccatgttgctgcaaaaattaacaaataccagagactagaactgactatttcccagcctcctccagaaatctgttgctgtgcaatgacaaattctattgcttcttctattacaagcggaatcagaaaaataaacaggctgttttgtactaccagacgaaataatgtagctctctttattggaagggattcataaaaatctgtctgctttctggaatgtaaataataaagacttactgccgcactgcatgccgccaggacgattaccacgcctgccattcccatattgggctgaaacaaacgaagtacttccgtatgtgaggaacattcatttactcccattactaaaaaaacggcttttataaaaaatgtaagcactgtaataatcgtcatgccaagcattctctttctattctccctgcttagcttagagtatgagattcttgatgtcataacctactacctccgtttcactgataaatatttcttctaaagacagcggaatacattcataaaataccggttttaatacagataactttgccattacctgtttttcactgcccctgactgtcattgtgacaagctttcctcttcggttaaattgtaaaatgtcaaacattttctccagcttcttgtcatcctcttttggcaatgcacactgtactttctgaatattacacttcatcgtttctaaatctttcgataagagaacaccacccttatgcaacagtccgacatgatcacaaatatcttctaattctctcaaattgtgcgatgcaataatcggagtaaactttctttcatcaatttcatttgccagaatacttttaattccctggcgcataaccggatcaagcccgtcaaatgtctcatcacaaaacaggtatttcacaccactgcacacaccaagaagaatggaaagctgcttcttcattcctttagaaaatgtctgaatcttacgatctttttgtaaagtaaacttcaccagaaacttacgaaatctcttctcattgaacgcaggatacaacgtcttataaaacgctgccatatctaacggtgtcgcatttgggaaaaaatactgctcatcagaaatatagaaaaacttctgcttcgcttccacacaatcccatacagcttccccatcaatcagaatctctccttcatcttcctttaacacccctgccatcattcgaagaagtgtactctttcctgcaccattcgttccaagaagaccaaaaacctgtccctcttcaatagaaagactgacatcacttacagcttcaatcttatcgaaacgcttgctgatcttcttaatttctatcatctttccacctcctcataagcttcattaatacaggccagcgcctgttctttcaagatccctctcgctctcagctcctctacattttctttaaacttaatcagaagcttctcctgttcttttataatcagattctcattcatcttcacaaaattccctcttccctttacggaataaataaatccttctctctccagctcactatatgccctctgaatcgtattgggattaatcgaaagttccatcgccagtgaacgcactgatggcagctttgaatccggctctagcactccattcaaaatcaatgtctgaatcttctctgtaacctgctcataaattggtcttttgtcattatagtcaataaaaatcacatcgagcctccttcctttttatactcataaaatcagatgtcacgaattactccacagctaacgctgctaaatcttcaaatacttcaggaaaacgcaacatatactgtaccaaatatgttagtagtgtattaacattattaatacacttaatataccttagatataccccaatgtcaagggggaggcgaaaaagtgaaaattctatcatacaataaatgcttcgtttccctgcgtccaaactgctcgtctgcagcttgaacttgctctaaggcgcatttattgtatgatagaattttcactttttctgtctttggcaggatttgagggagaagtcagaatgttgctgctaactctgatagttatatcagatatgatactatgttttctcaatttcgtcagcttttcccttgacaaatgccatatatgtattataattcaatatataaaatttttatatatagaaatttaaaacatagaaaggacgtgatattatgttttattatccgctttcttctttattgattgagtgtctgattctctcgattgttgaaagagaggattcttatgggtatgaaatcagtcagacagtgaagctggtggccaatattaaggaatctacgctttatccgattttaagaaagttagagcagaatggatacctgcatacttacagtcaggaatttcagggacgtaaccgcaagtattattccattaccgattccgggaaggagcagctcattttcttaaaaaaagaatggaacgaatattatcacacaattgatgacatcatcgaagggaggatgatacctgatggaaaataaaagatataaaaaggaacaagatatccatttaacaaaagaagaatatcttgcccagctaaagaaatatttaaaaagacttccaaaagaagattataacaatgcaatggattattttacagaatattttgaagatgccgggccagaaggcgaagcagccttgatacaggaactcggtactccgaaagaagcagcttatgaaattcttgataatctgataactgagaagagaaaagacccagatacgccgatttggaagattatttttcttacatttctttccatttgtgccgctcctatcggcggtgctttggcacttactataattgctcttgctttggccggtgttttagtaattgttgcaggacttttagcgattttctcttttggaattgcatttgccctcgttggtggaaaactttttatccgaggaataattgccatcactgcatcgctttccggtgcgagcctgatttctggggcaggattatttagtattggcattagtattcttgccattttagctgttttttgtttctgcaaatggattgttttagtattagctcattttattcagaacatgagcagaaaaaggagtgtgaaataacatgaaaaaaactacaagaacacttttaggaattggcggtgctttctgtctgattggcgcacttttattcggaatcggatttaccagtggcggcacaaagtacgttcatgccacaaacttaaattccatgaacgcacaggaagataataaagagtctgcaaatcgttttactttaaagaaaacagaaatctctgactttacttctttaaatataaacttagaagattccgaccttaacattgaggaatctcccaacgaaaaaagctatattgaatatgcacaggcgacaaaggataagaaaaaccctgtctcctatttcatagagaatggcacattaaccttaaaagaagccggaaatactggtgcttcttactacattaatgttgatataagcttcttacaggctgctctcagcagtaaaaatatagaagattacacaaaagagtcttctaaatacgaaaactacgttactctctatcttccaaaagataaactcgtatcttccgcaaaaatctatcttggatatggtgatttttatgtaaaaaatgctgcttttgatactattaacatcaagcttgacgatggagattttgacgcaaatacacttactgctaatagtggaaagcttactttctcctacggtgactgcgacttgcaaaaagcttctctcggcaatatttctctcacttcaaaagatggcgatcttactgtaaatgaacttactttatcaggaaaaacaaaaatcgcgctctcttatggtgatgctgaaatcaccttaaatgactccacaaagaaagtatctggatttgacctcgccacccattatggaacgattactgcttctggtcttaacggaaacaaaacgctagacgaagatgatgatgtaaatacattccagtcagattctaaagatgggaagacaaaacttgcgatagactctaaagatggggatattacggtaaaataatcagatagattttaaaagcagattatggctttttgaaaagttgagtcatgagagtttgacactcatattgttgttttaatatgtaaaaataataatttttcttatgcatttttgtgtcaatcctttgaaatttagtttcccaggtagcctcattcttctgtcctctcaccaaatttttattgacaggacaatctatcttaatataaaataaaaaaaataagagggagtagttaatatccatctttatggatgaataacagtcgtcatcacgccataaggccggttgttattgaaataacgagacttttatcaatcattttgtaactgttcagaattatgtacttttatttatgtattttaattctgaataccacagttatttttgatgtgataaaggtctttttttattttcctttatcacaagaaaggagaatatatggaatatgtattactagtcgtcggatttattcttttaattaagggggcagatttctttgtagaaggaagttcttctctcgcccaaatcctgaaagtgcccagtgttgtgattggtcttaccattgttgcaatgggaacgagcgcaccggaagcctccgtcagcattaatgccgcccttgcaggaagtaacgatatcgccatcagcaacgttgtcggatcgaatattttcaatggattagtcgttgtcggggtatgtgcctttttatctgcattcaaaacaaatcgtgatattttaaaaagagatatgccactcaacatccttgtcacatttattttatgccttatgtttcttgacggaaaactcaaccggatagaaggcggtatcctctttgccggaatgattctatatattactgtcatgatctatcacgcaatcaaaaataaatcggaaaacgaaccggaaaaaattctttctttgccaagaagtattatttacatgatcgccggtctcgctgcagtcatcttcggcggtgacttagtcgttgataaagcatgcatcattgccaccaacttcggcgtaagccagaactttatcggacttaccatcgttgcaatcggaacctcccttccggaactggtaacctccattgttgccaccaaaaaaggagatagcggtcttgcactcggaaatgctatcggctctaacctgtttaacatcttgtttatccttgggttctcagccatcctttcaccactgcacgtactaaatgaatcgattatcgactgtggtattttattaattagcagtatccttttattcatctttgcaaaaacaaagcagcatatgtcaaaactcgaaggaattgtctgtatcggactgtacctggcatatatgggatatcttttgatttaatttagcggatacagacgaaaaaaagaaagccagctatagcaaaggtaaagatagtcgcggcgtagaaaatgcctgaccggcatttttacttgctccgacattacctttgttataggctggctttctttttttctgttctctggctccagatatgataattaaatcttctataggatattcggtaatcatccactagagcgtgtttgaaaaatgcttataattaaacacagacacggtctgtttacattattattccggttgttttggtaagccggcaaatcctgcttctaaatccttatcggtaggaatatagtcgctcatctcaccattgttatatttttcatatgctaccatatcaaagtatccggttccggtaagtccgaaaagaattgtcttttcttctccagtttctttgcattttaaagcttcatcaatggctacacgaatcgcatgactgctttctggtgcaggtaagattccttctactcttgcaaactgctctgctgcttcaaatactgatgtctgttctacgcttcttgcctcaattaagccctgatcgtataattcagatacgatactgctcattccatgataacggagtcctcctgcatgatttgcagatggaatgaatccgcttcctaatgtatacatctttgccattgggcatacctttcctgtatcacagaaatcgtagacgtatttaccacgagttaagcttgggcaggaagccggctctactgcaataaagtgataatcggcttctccacgaagcttttctcccataaatggagagattaagcccccaaggttggaaccgcctccggcacatccgataataatatctggtttgattccgtatttgtccatggcaatctttgattctaatccgatgacagactggtgaagaagtacctgatttaatacacttcctaaaacataacgatacccttcatgcttcgttgcagtctcaactgcttctgaaatcgcacagccaaggcttcctgttgttcccggatgttcctctaaaatcttctttccaacttctgtcgtagtagatggggatggtgttacacttgctccataagtacgcattacttcacgacggaaaggtttctgctcataagaaactttaaccatatatactttacaatcaagatcaaaatacgcacatgccatagaaagtgcagttccccactgacctgctcctgtctctgtagtaactccctttaatccctgctgctttgcatagtaagcctgtgcaatcgcagaattaagcttgtgacttccacttgtattatttccttcaaatttataataaatctttgcaggtgttccaagcttcttctctaaacagtatgcccgtactaatggtgatggacggtacatcttgtaaaagtctttaatctcctgtggaattggaatataggcatccgtatcatttaactcctgcttcactaattctttacagaaaacaggctctaattcctctggttttaaaggctctaatgttgctggatttaataaaggtgccggcttcttcttcatatctgcacgcacattataccaactgtcaggcatctcattctcttcaagataaattttgtaagggatttctttattgctcatatccttctcctttgcaaatctttttcttttaatttaacaatttaacactctagtctaatacattatgctatacatagtttatactatctgtcttcctacgtcaagtatattactatttaattcattaagagacagacgcccgagaagagatacgatatcctatatttgtgactttagtcgctgcggtttaaatgctcgctttatgcgctcgcatctaaaccttgctccgaggccacaaatataggatatcgtatctcttctcgggctgtctttggctggattttgtttgaattaaatagtagttgtggagatttgggggagagggtagaagttttttgcttgctctcagaatattgcaggtcaaatcataccctctgctaccagtcattgtcgagtaagcagaatacatcagcttctgtccccaaatcccctccccctgtttaattcatcttctccagccacagcacagaagccattgcccccaataaggcatatttgtggtctcggagcaagtgttggatgtgagcgcataaagcgaacattcaacacgcagcgactaaaatcacaaatatgccttattgggggcaatggcttcgtctgtagtgtatctaatgaattaaatagcaactcaaaatgtcaagtcaagcgtaaaaatttgtattttttaagtagaatatcaaatgtttttctataaaatgacatgataaaatatgtttatattggctgactaatctgttgacacattttatagtcttgctataattttatatagattagcaccttaatatgatattagggacaaaataccttttgattctaatatcttaatatatgagaaggagagattattgtggttaaagtagaactattaaaagaattagataacggaattcgtttttattctatggaaaatgaatctttaaaaattgttgtggtaaatatgggatgccgcattatggaaatccacactccagatgcttctggaaataaatcagatgttattctcggattaaaaaatattgaagattatgcgaatgacccggcttactttggtgcaatcatcggccgtgttgcgaaccgaattggtgatgcccacttcacattaaacggaaaaacttacgaactgtatgccaataatggcaaaaatcatttacacggaggaaaagaaggattcgataaaaaaatctttgacgttactccgttagaaaatggactccgcttccactacttttctaaagacggtgaagaaggctatcctggaaatttaaatttatatgtaacttatacattaaatgagaatgcattttccattcactatgaggccgatacagatgcagacactgttgtaaactttacaaatcacctgtatttcaacctttctaacacattggataaagttaatgaccattatttacagattaactctgactatatcggatgcgtcgatgatacctgccttgcaactggagaacttcttcctgtcaaagacactccatttgacttcaacaaacgaaaacgaatcggacaagatctcgaagcagaccacatccaactgaaaaatgctttcggctacgaccattctttcgtattaaatggtacagaaaatcagttaactttagaagaacccgtctccggcagaagacttatcatctcaacaactgctcctgtcgttcaggtttataccggtaacttcttaaaagatggctgtatcggaaaagcaggcagagtttatgaaaaccgcgagggtgttgcattagaaacacagcttatgccaaatgcaatcaatacggaggaaaatccttctacaatattacgaaaaggggataaattcgaatcaaacacaaagtatgtgtttgaaataatgtagcttcttaattaaacagacggaagtaatctgctatcgttatggcaggtcgcttcctgtcttctgcaaatattaagtgctacattgttttaaacggggaggatttgtggattcagccgaaaaattatggtggatttcttatagatttcactccctcagtttatcaaaggcagccttgtagaaataaaataatccctatctctgacttcagagctgcttgaagactatattttgaaaagaccattataaataagtattaattttgtgactttgtgctacggaattttgaccatagaaactttgcattcgtttctgcaaagtttctgctttactgggcaaaatggagcgtttagcacaacgtaacaaaatcaatacttatttataatggtctttttctagagcgaccctctcgcagcgaccaaagacacagatagggattattttatttctatagggcgtatcctttgccaacaaatgagggagcagtctacttaatcattgtttctacattttccttcgtcactttcttatacggcagatagatacatctattattttcgaactgaatatcctccatttcctttccggtgactgctgcgatgacaagctctgccattgccttcgcctgcccttctttatcgttataaactgttgcggcgattttacctttctgaacggcttccaaaccttcgtctgtgccatcgataccgaaaaatactggtatatttgattctgtatagcccagtttttcgtaagcatcaattgctcctaatgccatggaatcactgttggctataaccatttcaatatttgttttgtattgtccgataagctgcatcattctggtctgtgcctgtgcacggttccagtttgcaatctgataacttagtttttccagagaaatatcgttggctttcaggctttctactacgctttcggtacggataattgcatcctggtgacccatttctccttccaaaataacatattggatcttcccgtcattattgcggtctgcctgcggattgactttaataaagtctgctgcaagttctccctgcagctcgccagattgtttcgcctttcctcccacatagtaaagtttatcccatcgcctcatatcctcctcaaccggttcccggttaaagaaaataattggaatgtctttttcttttgcagcatcgataatttctgatggttcagttcgatctgccaggtttacacacaacacattacatccatcgttaatcatctgctcaatctgatcattttgtactcgctgtgagtttgacgcgtccataatcgtcatacttattgcataatctttggattccatcgaactgcactgttctttaaatgcatctaccagttcttcgataaaggtgtccttctgatcataacaggcaactcctatataaatctgattatctgtctgcggctgacttttaccgcatgtataaaaaatcagtgttcccgcaaatatgaccattattattattcctgtgatttttatcttcatgctgtcctccgattgattttttatattcccagaaacttgattttgtgtaaaatctttatcgatataatatataattgtgctatatattttacttactaagtgtaaataacaaatcctgattctcttttgaaaaaagattatctctcgtgagcaccgtatatggtacttcctgatttttcatttgataaaatgttttacgaagagcgtttactgtttcggcaacacattgataaccggcagtaaattcatctggaacaatgagacattctgcccatcgtgcgtcaagataatatactgcctctgtggagttaccgattccatatacgattgctccatacagattgttctgtttgacagattcccctgcttctacaaaacttgtgtcatctaatgccagaacgatgtccacttttctttgtgactgtaatgttgtatttcgttttatttcctcgtcacgggaaacggtccacactatttcagctcccgtgccctttaatgtatcgcagactccctctcttcgattgagatctgcttctgaattactgttttccagaaaaattcctattttcttgccagatagattcccattatttttctcaagtaatttttgtaccaaagccacccccatctcatactgatctggctctgttaccgggatatctgattgctttttggtttcggcaagactttctcccgccaacataatcggaacttttttctgtatctttttcaactgcgaatactcattactgtttcctgtcattttaacaataatagcgtctgctcctttatcaatctcctgttttacgacctccatttcatcctctgataaattaatattggatttactgataagtatggtatttactccatattcctgggatgccatttttaagccgtatttgaacgccgaccactgactttcttctatatcgggaataatgacagcaattcgttctgtcttatcttcatttttattatacagcataaaaaatgccaaaatgacaacaagcattcctaaaataatttctgttaaaataaagcttctttttccatttttcatcttttttctttctgcgttctgactgctcccacaggcaagcctgtggggttctgattatcaagtgtagcttgtaatcgtacaccatttgcaggctttggagttacaagtgtaaatctatttaaattaggactttcattaccaagcagtccaacgaccacattaacggcaaaattctgcttttcagcaaggaagtacagtcaatctcccttattattaagttattaagctattttaattccgctgtttaatactttaatcttatgagccttaatccacgtgattagggctttttctttcttatagcaattatcaaactgggttatacatttgtttttatctatcttctgtatcttatagtcgtaacagtaaagcaggaatgatgaataccaatccctttgtacctcagtaccatcttgtagcttatataatcggtcagatagtttctttttgatatagtcatcaacagtatggtcgtactgtgaggctctgtaattatttggtacttctatatatgtaccaccagtagtcttaaacttcttttccactgtagtctggaacccagaggggcatcggttctttatggatttaccaaaacgcttcttcttattgaacctgcctttgtcattaaccgcagtttctttcgctcgcttcataagtttgctggcgtttttaggttctgtgacgaatgtatctccaagacttcgtaaatggttagcatcttcgtttattgcaagctgtctgttcactgcattgatacggcataattcagaatgttttgctttcagtttcttataatgatttgaatatttccaagtcttacgacctttcttaaccgtaccgtcttcattgtagttttgtggattcgctgcccgccttgacctgtccatagcacgatagagcagacgttcttttctttcagaagtctgtatgctgttgccacgctctgaaagattctttaaaccaacttccgtatcagatgtataagcaacagtctgtgtgccaatatcggcacctatcacccctttaccatacttgtgacgaggattaccatgcttatcatactttagttttgttttgccctcaatggtcagatgcacatataccctgtatttacctcgtatcatcttaataacaagagtggcatagcaaggtctgtatgtgtctatgtaataagcgtcttctatgagagtatttaccgctttgttatccacaatctcaggttcggcaagatatgttaaaacggcatctgcttcgtcctgttgaaatctgtcatttacctgtattccgaaagcggttttgccaagtttgaactgcaatctgtcatcttttacagatattggaatgccacgatttatctgttttgctcgaatacaaggcagttctccatattttgagaaatgaatagctttaccattaccatacaggcatttctcgataccccgccaaacatcctccgcttttgttaatgcaaatacagcatcgattccatatttcctgcctatagggatcatagatcttctgcaatgatcccatgtgacattataggctttctgcatttcgttaagttgatcagctaaatccttacgtttctttttatccttggtagaaccatagagttttagcaacttgcgatattttttagtacgtataagctggtcataattctttctcataaaactaacaagctcattacctgctttgcgtatcttatcagaaagaatcataactttaagtacatcagaataaggcatatcggtctcaacaaccaaaatatgcctgtcagaaagtttatgaaattgttttagaagttttttatattcttcatcacttatcatttttctgctcctcgatatacttaattactgtagcttcacttatatgcccaactgttgacacaaaatatcctcttgaccatagaacaccacatttcgcatagaactgttttaatcttgggaatactctaaataattcgacagcactgatactttttagggttcttgcaacatcacagggagcaaccgtctgcggaacatctatgaaaatatgtatgtggtcaggcatcacttcaagtgccttaatgtgataattataatcatcacagattttctgtaatatctgtttcaaggtatcctctacattgccttttaataccgaaaatctaaatttcggacaccagatgatgtgatactgtatcagatatttacaatgtgatgctgaatgatattgttcctcactcatgagcttgttctccaagttgatatttttcctgaatacctctacgcatcagatcaagaaatgtgatagtttcaccctcctcgacagaatagatacgtgcaaggttttcaagttccgctttccactcagagggaatagatatattgacttgtacattatttgattttagtcgtgccataatattctcctaattataatcttcgcaacaatattcttcctctacaatttcttcatcatgaaccatgcaatgcaaaatatcatttccattgtctgatggctcagaaaaagaatttgcacaattcaaacaatcttttagacattcatacatatacttaaaattctttcttttatactatacatagattatatatttattctatgcttaagtcaagtcaaaaaaagtggctttcatcccacacgcaagcatgtgggtttttcgccacaaatttataacattttttatctcaattcaaaaaaactgactaaacacgctctaaatgaactttcaataataaaatgtaattacgagcagccactcttagatgtgttctcaaacttcttcctgttttcctctgaataaataattgccggtattctgatagagactgtcgttccttcatctaattcactttcgatatgtaaaccgtatttttctccaaataaaattttgattcggttatttacatttacaagtcccacaccagagccttttttatggactctttgtgtgtctgtgagaaggaattctatctcttcttccgggatacccattccattatctgcaatggtaaaaagaatctcatcctcttcttttcttccctgaacgatgatttctccacaatcatccatttctcttacaccgtaattgattgcattttcaaggattggctgcaggattaacttcacaatgcaacagtctaaaatatcagaatctacatcaaacgtaatctgaaatttgttcttatagcgcaccttctgaatattcatataactttgcgcatgttgtagttcatctcggatagaaatgatggtatggcctttggaaagactgatacggaacaatctggcaagctgcgagatcatgaatacggcatcgtcattcctctctccttcaatcatccatgtgatggagtctaaggtattataaagaaaatgtggattaatctgactctgcaaaacttcaagttcactttttcttctctccgtctgttcccatacaattttctgcatcagggcattattctgcttataagaatcctggatggaccttcctaaatgcctgatttcacgggaacctccgatataaatctccggctcttttccctcttcatattcggtaacagaattatttaacttcataatcggacgggatattcttacggataccagacggttaataagagtaagcatcattgccataagcaaaatcaagataagcacaaaatgctttacatcaagcattttgttggaaaaaatagagtatggcatgacgcagaccagtttccagccggtataacctatcgtatctacgacaatctccctgtgctctccattgattcgttcttcatacacactttcttttgctcgggcagcctttttactgctctcctttttcattccattatcaagctgtacctgatgtggatgataaataatctgtccgttgctatcacacagataaaaatactgcccgctgtctgtcgtattaatccgttccatcattcgtgaaattcctgaataatccatgtcaacaagcagtacacctaattgtgtattggtcccatccgtcaattctacaacacggcttgatgaaatcacccagtaatattgctgcgttccatcatcaaatagattctgtacatgaggtgtggaaaaatggatattttccatttgattcattgcctgaataaaccagtcctgctttgtcacattcggatcttccttttgtgccacaacaggttctgcctccagcaaactgccatactgattatagatagcaatacttcgcagattctctttattagcctcatataaaagattcattccgttatgcatcttgtctgactcactcgacatatcactttcttttataatattataatacaaggcatccgatacctgccgcatattgatcagataatcttccacactctctacggtctgatccattaacctctgattattttctaatatttccttctgggacatactggaaaaacgcaaatacatcacgcttcccatacacagcaaaataactgctgacacaactgaaaacgcaatcatcaatgttgcctgaatagttcccggtttgtaggtaaatattttacgattgaatatttttttcctggatatttggggactgaatattttctgtccggatattttctcaaatacttttttaattactttcatactctgtcctgtattttgatggggataccccatactgtctcttaaatacatagctaaaatagttcggatctgtgtatcctacacttttcgcgatcatatagctcttttcactcgtctctacaagcatacgggctgccttctccattcgatatcctgtaagatatgctacaaaggactgccctgtttctttcttgaaaatactggaaaaataggaatttgatacacccagttcactacatatatcatctaagttaagcgcttcatttgagtaattgttatgtacatattcctttgcctggtcgataagagacttcttagaatgatctcgggcgtttgccatatcttcatgtaataccagacaaatatttaaaagccatttttcaagtatccgcgcttccatattgcttaacagagtgtatagctgccctgttccacccgataatttctgaatatccagctcattatttaccataaaatgatataactcactgataagttccattaccgcaacatgatatctctccaatgactttaacggaataatctttcgttccatatatcgttccacggctgctttcacatccggcttctttccaagacagatcatcttaaagaggtaagcaagttctgtcccatccgctgcctccgttgccacttttcttgtcggaacaatttcctttaagttaattgcctgattacttccatataagacgcggtaagaaacagcttctctcgcactctgataagacttcacaagatcagaaatattatcacagatctgtccgacaccgactgtcacaactgctcctatcatatgatgaacatatttgcaaaatcggtcacaggaatcggtcagttctgaaacttccttttcactttcaagctgcacgatcattaccgtgtctccaagataattaaaccgctttgctttccacttttgttctaaccgctctcccgcctgtttatctacggatattgctaccagctgcggatccatatctttgggaacctgtgttttggaagcatgaatgagtacacatccatataatggtccggtaaaatcaatctgataattcgcaagatatttggtaagttcctcttccggaacccttccctctatgagggtagaataaaagtttgcctgcaaaagcggaagagaatctttataatacttcttcaaaagttccgcactctttttttcattgatttcctgatctaattttttctttaaatcttcaaaaacttttgtgatttctgcagcatttaatggctttagcacatactcctcaatctcgagatgtactgcctcttttgcatattcaaaatcatcgaagcctgtaaataaaacgagctttgttgccggatacttctctcttatctgcccacacagttccagtccatccatatatggcatccggatatctgtcataaccacatccggctgcatttcctctaacatttctaaggctttcagtccattattggcatgccctgtcactgaaaatcccaggtcgttccattttaccttttttgcgattatccgtgttacttcttcttcgtcatcaactagtaataatgtatacatacgtttctctcctaacttactgatattatatcaattttcaaaacataagtaaattgtgtccaacaaagattcttcaaacagcttatgctctctttaatctaaactaagcgtctgtcataatagcattcaaacacgctatagcacaaatagagatgccagatactatgcaagggaagcatatatactggcatctctatttcatatatttataacaaaagaggaaagaaattaactattttttctgaacgtatttcagacagtcaagtgttactgctacgagaatgatgatacctgagaatacgaactgaaggtttgtatcaataccaagaatggtaagggagtatgttaatgctgtaaagatacatacaccagtaactacgccggaaatcttaccaataccaccagtaaaggatacaccaccaactacgcaggctgcaatggcatccatatcccagccctgtccataagctgcagaaccggaacctaccattctggcacattcaagccaggaaccaaatccgtaaaggatacctgccataatgaatgctccaagtgtaactgcgaatacggagataccggaaacagctgctgcctctgggtttccaccaacagcgtacagattttttccaaatgttgtcttattccagatgaaccatacgattatgattgctgctaatgcccataaaataatagtagggaatccatttactttaggaataatcatatttggaatggttgcttcgatagaaccaaaagatacaccctttgtcgcgtatgttactaaaccgaagattacaagcatgttcgccatcgttgatatgaacggatgcatcttgaacttcgctgtaaaaaatcctgcgatacttgtaaataccgtacacaaaacgatacatacaactaatgccaaaacaactcttccaccaactggaatatttgtaaaatcaaaggtatgtccaaatacagtacctgtatttataccctgatgcataataatggttgctgctgtcatacccataccaaccattcgtccaacagacaaatctgtacctgtgaggaggatcagtcctgcaacaccaagtgcaaggaacattctaggtgaagcctgctggagaatgttcagtacgttattatatgtgagtaacggggttccttttttgattggggtgattacacataaggcaacgaagattaaaataatggcaatatacaatccattctgtaaaaggaagcttctgcggttaaaggtatatttgtagttttcccacttctgtgccacctcttctgcaaatgtgaattctgacaaccgtaataaatctataagatgatacttataagtaaaggcatcgtgttttctgtctttaattcgctgtttttctttttccagctctaacttttcattggaaatacggtttttatgtacgtagttctcttctttaatctcaacctggtcagacatacctgccaatgcttctttatgctctttctctaactgagcaagacgctgtttgtgatcttctaaagcttttgctttttctgcttcgcagctttcttttactgcattataatacagtttttcaaagttctctttcaaatagctttccgcatcagagataagttttgcgaccttatctttgttctgtgcttctaccgcttttgcctgacttaactttgcttcaaattctttaatttcagattctttctctcctttagagagtgtcttatctctttttacatttgcgataagattctggtactcgattacttctgccgtaccatgttctcttaactcatcaatttctttttggattttaccaacatattcatcaataggctgtctcagttttctttcctgttcagccgtaagaattgcaccattagccatatctatcttctcccttaattataggtattttgcactcagtctcaaaagttcttcctgattcgtctccttcgtatttacaattccggaaagatgtccgttagacataacaccaatacgatttgtaataccaagaatctctggcatctctgaagaaacaacaatgattgtctttccctgttttgccatctggataatcaactcataaatttcatattttgctccaacatcgataccacgagtcggctcgtccatcatgaatacctgtgggcctcgctccagccattttccaaaaataactttctgctgatttcctcctgaaagacttgagatcatatctccaggacccatacatttcgtgtgcataatcttgatttcatttgaagttgcctttaccatcttagggtcagaaatcgcaactccctttttgtatgcatttaagtttgcgattgtggtattaaaggttaaatctccttttaagaaaagaccattcgcctttcgttcctccgtaataagagcaaatccataatccatcgcttcttttgcacaactgaagttcataagtttattattgagatatactcgccctgccgctcttgttcgtataccaaagattgtctctaacaattctgtacggccagctccaaccagaccataaagtccaaaaatctcgccttcatgtacatcaaaggaaacatcctgtaagtacggctcaaactttgtagacaaatgctgaacagataaaacaacatctccaggctgattatctactggtgggaatcggttttcaagaactcgtccaaccatcgccgtgatcagttcattcatgtttgtctcttttgcactttttgtcataacaagattaccgtctcgaagaacggagatttcatcacagatttcaaaaatctcatccatcttgtgagaaatgtagatcagtgagattccctgatcacgcagcattctcatcatttcaaaaagtttatctacttcctgtactgtaagagatgatgttggctcatctaatacaattactttggaattataggaaatcgctttcgcaatctcacacatctgtctctgggatacagacatattcctcatcggctgttctaagtttactgtcattcccaattttcggaatagcttggaagcttcattcttcatccgcttttcatcgatgactccaagtgaattgaccggataccttccaaggaaaagattatccactacgtttctttccaggcactggtttaattcctgatgtaccatcgcgattccattttcaagggcatccttcggtccggaaaagtttacttcctttccatccagatatatatttccttcatctttctggtatgtaccaaaaagacacttcatcattgttgacttaccggcaccattttctcccatcagacccataacggttcctctcttcacatccagattgatgtgatcaagtactctgttacgtccgaatgatttactcataccacgtatcgataagataatgtcttctctcttatcctccatacttttctgctcctataattaagatattaactattactttgcttcttaaatatggggctgtctcactctccggcatctatgttgttatgccctcttagctcggcagccccaaaatggtttgtttgtactattaaagttttttcatcatataagcacaattctaattcacagtcttatgtaagcctgatacagctttctataaatcttcatatgagtctctatacagtttccttctatatagcttacatataaatccctctgtaaattatttgccttaaatggctgcgattactgatttaaaatagctgtgtaagaagctgcattatctgtcttaaccatgttgattgcaaatgcatcgtactggtttggatttccaagacggtttgtaacgttagactctgtctgtccatcaccaccgatgtactctacatcaagatttaaaagatcatcatagttctgtaaaagtggctgatatgttgagcttaagaagttatcagaagcgttgtagatattgagccatactttctttgtaggatgtttggatgaatctaactggttagatactggtttccaaacaactgtagaatctgtgaaatctttgtagttatctgctgtaactgctgcatttaatgcatagtaagaacgttcttcttcactatatttatatacgtcttcgctaagaacatttcctgcttcatcagcagttccgatacctgtgtctacgtcaacaccatcaagtgcgttacgaagtactctgagtgtaaggtaagcctgaacatcggcatgctggctgactgttccgccgtaaccttctgcgatagctgctaccgcatcactgtttgcatcgtatccaaatgtaggaactttgttgtcttttgaccatgcgttaaacattgacattcccattccatcgttgttagaaacaaccacgtcaatagaatctccaaaagaagatgaccatgttccaatagcattacctgctgttgctgcatcccatgtagctccggcagagttcttcatttcctgagaagcaagttctcttacaacatatttctttccatttacttcaagttctgcatcctgaacctctgcagcttttccgtctgtgttagttcctgtaggagcactgttgatttctccatctttctcaacgcctgttccaagagctttacgaacacctcttgtacgagcgatggaatcgttatgtccgatatcaccgattgctaaaacgtatccgataacaccatcaccgttacggtcaatcttatcaatatttttctcgatataatctttaaccatctgaccctgaacttcagcaccctggtttgcatcgaaacctacatagtaagtatctttgttaaagttaagagctgtcttatccagttctcctgtagaactgttagaaggctgacggttaaaccatacgagtggtttatctttatttgcaacttcagaagttgctgctgcctgacttcctgtgtttgattcgctcttgctgctactgctgctaccgctgctaccacaagctgctgtagaaactactaaagctgctgccatcatcattgctacgactttttttctcattataagtaccctcctcggtttttgttgataatgacagtatataggattctttactgggaaacgatagaatatttttcgattcacattaaaaattctatgatttcgtttatttaatgggcaaacagacgaaaccaatagggcatattggctctgctggtttcgtctccgtcaatctacaaaaaagttttcaacacctccagcactccattttcggcatagcctggaatgacttcatcggcggcttttttagtttcttctcttgctgtgtttactgcatatccttttccggcagactgaatcatagaaatgtcattcaggttatctccaaaagcaatcgtttcttctggggcgattcccaattggcggcatatttcttccagtgctgtcccctttccgacttctggcattacaatatcaacccaatactttccagaagtcaaaaattctaatttccctttccatttatcttccacaagttctttgcaaatattctctgcactttgcggatgatataaagtcatcatactaaaatcttcttctggaacctgattccaaccgcctgttccagtaacattaaaatgatactcatctgcaagtatcttatacattgaagtctcctcaaaggggcaatacatttctgttgctgtatcaagaacaccttctactcctttcagttttgaaaattgtctccacatctctcttccccactcctgtggaatggactttatgattcttgactttccgtggtaagtcagtacatttccattttgggacgcaacccatattttatctaaaacaggggcaaaaaccttttttacactactcatatgtctgcctgatgcaacaacgaatataattcctttttcaactaacttttcaatcacttcaaaatactctggattgatatccattgttccatctggtatcaaagttccatctatatctgtcataattaattttaccattattgtcctcctattatttcctgatcatttaaatatgtattgcttaaaacactctcgaaattaaaaactttattgaatagtgtgagtatatagcatgattgatatatttacaagcaggtgctattatattgataatcaatcgctttttgtgattgttattgacgtttatcaatcatattttctgattgcttttgtttaatatagataaaaatattgatagaaaggacattttacatgataccagacgaacgtagaaaagagattttagaattacttgatgaaaaggggtatgtttccgtaaaagacctgtcacaaagattatatgtaagtttacctactatccgtcgtgacctcaccttattagaaagagagggttatgtgctaagaacacatggcggtgcttcccttagtatatctgactcttttgttgaaccttttgccttgcgtaaaaaaacaaatcttgaagccaaaaaatatattggaaaaattgcggcttccctcatccataataatgatactttatttattacctcaagtagtacctgcctggaattcgccaaccatatcaaaccagaccttcgtcttaatattctgacaaatggaatgcccctcgctcataaactatcggaaaacaataacgttactgtcgaatgtcctgccggtatctataattattttcatgaaggaatctatggaaaagaagtaaaggaactaatcagcaaacgttatgcccaatattgttttacttcctgcaacggaattgacctaataaatggcctgacattttcaacggaccttgatatgacattgatacgggcctgccgtgacaattgcgatcagcttattgtgcttgcggaccatacgaagtttggaatgacctactattttaaaactctcagtataaaggaaattgatgttattattactgatcaggaaccagcggaaaaatggatcacttactgcgaagagaatggaataaccctgatttattaacttctaatttgtaagacagcaaaacagacgccgctacaacttccatagcggcgtctgtctctgagaattcctggttttctccttctccatattcttgaaaataaagttttcggacagcctgcaaggactgctttaaatttcttcctttccgcctgtcttttcacgaatcacaaaaagaatcgcaaccaacagaacaatacaaaccggaagtgccagaagtgaaaactgtgtcagccctacagcctgcaacacaccaattataaaataaccgatcatgcagacagccgccaccaatcctacatatggaagctgtgttgccacatggttaacatgctcacaatggccgccagccgatgccataatggtagtatcggaaattggtgaacaatgatcaccgcagacagcacctgccagacaggatgcaatcgaaattgccatcatctgaccagatgggaatacaccaattacaattgggattaaaatactgaaagttccccatgaggttccagtcgcaaatgcaagaaatgccgctactacaaaaatcaccatcggaagaaagccctgaagtccctgcgcgaagtgctgtaccatatcggctacaaatacctttgcaccaagaagatttgtcacgccagacagcgtccatgccagtgtcagaatcatgattggtgcaatcatggacttaaatccatctggaatacactctgtaaactcacggaaagaaagtacatcacgcagcatataataaacaaaagtaaatgcgagcgtcacgcttccaccaagtaccagacctaccgatgcgctcgaatttgcgaatgcatccacaaaggatgctcccgtaaaaaagccaccggtataaatcatggctacaatacagcttgcaatcaatacaactactggaagcaccagatcaagtacatgcgagttttccttaatgatttcttcttcattgtcctcatacggtcttcccggtgttgtaaacaaatcaccggcaatagcattcatctcatgatgcttcatcggtccaaaatccacacgcaaaacagtaattgtaagcagcattactaacgtcagaattgcatacagattgtatggaatggtctgaataaagaccgcaaaaccattaattccagaatcggctggaacagatgacgtaactgcggctgcccaggagctgattggtgcaatgatacaaaccggagccgctgtcgcatcaataatataagatagctttgctctggataccttgtgacggtctgtcacaggacgcataacacttccaaccgtcagacaattgaaataatcatcgacaaagattaacactccaagaatcataacgctaatctgtgccccaatccttgttttgatgtgcttagatgcccactttccaaatgcagcggaacctcccgctttgtttagcagtgatactaagatacccagcatgacaagaaatactaaaattccaacatttccggagtcagacagcttgcttaccatgccgccatcctcgttaaatagcatcgtatttaacatcaattccagattgccattggcatacaaaagtgctccagccagaattccggccagaagtgatgtatatacctcttttgtaaaaagtgccagtccaattgcgattactggcggcagtaatgatagtgctgttgcgtatacgacgcttgtatactcaccatctgcagatggtttgcccgtcagcatagtgattgcaagcaatacggcaaataccgcaatcagtccaagcattacggcttgttttcttttgactttcattttcattatacttcttcctctctgtataatttatattgttgggaaaaacacttctgagacatatcttgctacatattacaagccacataaataaaattaacagcaaacgattacacaaaaacagagaagcccagatggacttctccctcgaaatcttttcttacctcatcgtatttctcgaaatatagtacattgtagcatgttatttttaagaatgcaattattcattgcgattctctttatattaatttatatttttgacataccatacgcatacttcctgcaaacatacgacaaagtatgcgggaatgctccacaatgtcatacgacatgtcatgattcagccagtcaataagctgcccaaacagctcacactttaaataacttatgacaaattctaagtcttttgaagcgaccttttccgagtaatctctggaacggatataggttcgggtaacataatcacaaattttcataagctgcttctcataaaattctctgttcgaagatccataaatgtggtaaatcatccttttattcaaattaatctcttccagagccgccgtaactttttcctcaaatgtagattcctccggcaaattttctatgactttcgcagtcatctctacaataatctcttctaataaagaagggatatcctgaaaatgataataaaaagaattacgattcacaccacagtcctctacaatatccttcactgtaatctgggaaatcggtcgttctgttaataactttataaaagaatttttaatttctcttttggcaaaagggggcattctggcacttcctttctcaacttaattcaacttattaccttatataataatgccacaatgattacgcactacatgcaacataataccatatcttcgccctttattccattaaattttctaaaaaatcaataaattctttcttggtatttgtataaagtatctatacttctttctcttccacctcatgatagattctaaatccatctctgccacttctttttgttgtataaagtgcttcatcagcatgcttatacaactctccaaatgtcgtgccatcttttggcataaaggccgctcccatactgcaggtcaatgtatgttcctctaactcctctatcggaagttctctgagatactgctgtaaattctccatcctccgaacggcaaattcttctgaagtgattccctccataaatataagaaactcatctccgccaattcttcctacaatatcattctctctgaaagaactcttcaaaagatgaccaaccttatataaaactctgtctcctactgcatgaccataagtatcattaatctgcttaaaataatcgacatccatcatcatgagaacagcaccggccttacttctgtcactatgcagccactctttaatacgttgttctgttcctgctttattatatagctgtgtcagtccatccctgctggcaatctctctcatcttcttctgtttcatggatgttctctggaaaatgagaatgaaaaatgtaatcacacccacaccaatgaccgcaaacagaatcacttccttatttccaataaactgaaattcctcctgtgctttactttgcggaaccagatagcagagcatccaattattgatatgcaacggctcatatgccagatagctcatggcattcttttccttaagaacaagaataccagacttttgcttcttgatattagcctttgctgacttcattgttttctcggcaacctcaccactctttgtataaaaatcatatacattatcattaataccaatctttcgataagaaagtccgctatcacaggaaataatttttccggaagtatctatgatcatagaaaaaccaatgccatcataaatatcattaaataacatctgattcaacgcacctacattataggatgctccaagagcacctgtcacttttccattcctgtaaattggtacagcaagaatcacttttgttcttccatctaccttactttcaattggcggactcattatcttttgtccctgcatcactttcttaaaataccctctgttttttacattctttcttgcaccgttattgtaataagtatctccatctgccttcataatgcctatcagatccaaatcctgttcttttacaatactctgaatcagccttttattctcctgacaaaacagatcttctccttcacccatgtaagaagccatacccgtcagataattaaactgaatatccagcactgacttcaaatgatagctctgcctctctacatttgttgccacagtttttctactgctaacttctacatcctgctgcaaccatgataaaaagaataaaagactcaatatcataaaactaagaaatgctgctataatcagaaaatacctttttatctcgttttgttcgattctcttctttttcatgttgccatcccctccccaaatatactttgcaatgtataaattaattataattttatcataccatagcatttttcttctgtcagtcatattcttttacaaatggcaataagttttcgacaaaatcagaggttttactatttaattcattaagagacagacgcccgagaagagaaccgataccctatatttgtgactttagtcgctgcggtttaaatgctcgctttatgcgctcgcatctaaaccttgctccgaggccacaaatatagggtatcggttctcttcccgggctgtccttgtctggattttgtttgaattaaatagtggttgtggggatttgggggagagggtagaagttttctacttgctcttaaaatattgtgaatagatgttttgtatttaaatagaagtggtaatgaattgatattgataacaacagtctgctttttattctgaaaattattgaaatattgctgaggtaaccattaaaaaagctaaatcatccccctgttcccagtcattctcgaataagcagaagacatcagcttctgtcccccaatcccctccccctgtttaattcaccttctccagccacagcacagaagccattgcccccaataaggcatatttgtggtctcggagcaagtgttggatgcgagcgaatagagcgaacattcaacacgccgcgactaaaatcacaaatatgccttattgggggcaatggcttcgtctgtagttcgcttaatgaattaaatagtaatttaatactgagattcttctttgataattgcggcaaattcctccacgctcattgtgccaagttctgggctgtcattctcatcaataagatctctcttacgaacagaaaccgttcctgcgctctgctctttttctccgagaataagcatataaggaactttctggagctgtgcctgtctgattttatagccaagtttctcgtcgcggtcatcgacttctacacgaacgccgcttgctttgagtgcttcagcaacctgttttgcgtaatctgcaaatttgtcggatacaggaagaacttttgcctgtaccggtgctaaccatgttgggaactttcctgcataatgttcaattaagattccgataaatcgctcaatagaaccaaatacaacacggtgaatcatgattggacgatgtttttctccgtctgctccaatatattctgcctcaaatctctgtggaagctggaagtcaagctggattgttccgcactgccatgttcttccgatagaatcctgtaaatggaagtcaagttttggaccatagaatgcgccgtctccctcatttacttcgtaaggaatattcatggctttgattgcattttccaatgcatttgttgctacttcccactcttcttctgttcccatgctatcagctggacgagtggataattctacatgataagtaaatccaaatttcttatatacttcatcaatcaattttacgactttctggatttcattttcaatctgcgcctctgtcataaagatatgggcatcgtcctgtgtaaagcatcttacacgcatcagtccatgaagctgtccggacttttcgtgacggtgcacaaggccaagttccccaagacgaagtggaagttctttgtaagaacgaggctccatcttataaacaagcattccacctggacagttcattggttttacagcaaaatccatgtcgtcaattactgttgtgtacatattttctctgtaatgatcccagtgtcctgatgtttcccaaagctgtctgtttaagaggattggtgtggagatttcttcgtatccttctcttgtatgcatctttctccagtaatcaatcagagtatttttcagaatcattccctttggtaagaagaatgggaatcccggaccttcttccatgatggtaaataatccaagttcttttccaagctttctgtgatctctcttctttgcctcttcgagcatattcagataatcttttaactcagcagcttttgggaaagaaattccataaattcttgtaagcattttgttcttttcatcgccgcgccagtacgcacctgctgtagaaaggagcttaattgccttgattacacaagtattggatacatgagggcctgcacagaattcttcgtagtcaccctgtttataaaatgtgattgtctctccttctggaagttcctcaatcatttctactttgtaatcttcctgtctttctttcatgtaatctaaggctttttcttttgtaacctcaaatacttctaatggcagagactgctttacaatcttcttcatttctttttcgattgctgcaagattttcctctgtaaatgggaaagagaaatcaaaatcatagtaaaatccattatcgattgctggtccaatcgcacatttcgtatctggatataatctctttactgcctgtgccaatacatgggcgcttgtgtgccaaaacgcttcttttacttctttttcttcaaaattaccttcgattacctgtccatttttttcgagaactttcatttctttttacctccaaaataagaatgaatctgatttgggaacgttaatagtaatgaatatagaccgctgcagcttacaactaaaacatatttgattaaaaagtctacatgtcttacttttaatttatatcaaaaaagcacccacagattacagcatagctataatctaagggtgcattaaatacacggttccaccttatagtttcacttcagattctctaaattaaatcctatcccttaacgcgggcatacggcaacacttgtgaaatatcttaacattcatcaggatgcttctcttgaaacatcttcatataatctgtatagttcttttaaaatatttctttttcgcatcgcagctcaggaatggttttcatatacttcctcataaataactctcagcaactgttactctctctgtatgatttcgattatattactcgtttccctcatcgcttttccttgtttcgagtgtatggtagcactattaaaaatatttgtcaatcatttattttactttttctggtcaaaaaactctttatattctctcttacattttcttttacattcgcaaaatattgtgaacgcacaatctttctttccggatagaaaacttctccccatggataagattctgtagccccatttgttttttgtccatttatgatagcatcagttagcaacatggctgctgtcattgcggaagtcattccccagccattaaaccctgtagcaacatacatgttcggggtcttatctgaatatggtccgatatacggaattccatccaaactcacacaatcttctacttcccaatgctcccgctctattgcctctggataatacgataaaatcttctctctgaattcattccaatcacgttcttcctgccctactctgtgggtagctcctcctacaaaaatcatatctttatatcctcgcaatgccagtctgttatcagacgcatctgcatacattccatgaagctccggcacatgatcaagggccatgatataggaacgattctgatatagcttattattatatcctcctgctttcttataaaatggaaaatgtgttgtacaaatgatatttttcggaattgttatatagagtccgctccatgttgttccatttatccaatcatctacaggcatttcttcaaaaatagttaccttatctgacttttcaatatcttttaccagaccatataaaaactttacaggattcatctgcgcctgattcggaaaacgtactgctcccgccgtatcaaatggaagctccggtgtctcacaaaattctgctttcataccaagaagactggctgcacgcacttccctctcaatgcattctttgtctgttcttgaataaatataggaacttctctcctcaaaatcacaatctatagatgctgccaattcccgatacttatgcaatgcgagttcgttcgcttcaaagtacatgcgggccttctcttcccccaaagtttccagcaatctgctgtatataaggccatgctgcgacgtaacctgtgccatcgcatgtctcacagttccactgcctatcctgcttccctcaagaagcagacattccactcccgcctcctttaagaaatacgcacatagaagaccacataatcctcctccgacaatcgtgacatctacttttttgatacgagtcagcttttcatattgaggcatctgtattctaccaccatcactccatatagaatctgacatttttcatcctcctgttaatttacttctctacatcttattctctcttaaaatcttctctaatatttttattatacactaaaaaagaaaaagaatattattaatttttcttaaacattctttttcttttctctatatcatttttcaaaatgaccttatatttttttaatttataaaaatattatcaaaatatttttatggatatatttctttataactgagatgttttttcttccccataaattataaaaaaatttctgatttcaatgtagccaaagacagaaaatcgaagcagcatctcacccaatctacgacttcagagctgtgagaaaacaacctccgttagaaaggtccctcattaaaattattgattttgcgacttttgtgttttttacaacggagtcaaaatcaataacttttaatgaggggcttttcatagaagacttcctctcgctgcgactacagccacagagatgttgcttcgattttcgtctgtttgtctaactaacccagaaatttttcttccaattcatgtaacctttttgctgcttctggattctgtttttcgagtcttctttctaaatgtttgcggctttctactaacttctgccagatttctggattttcctgttttaattccatttcgagatgctggcggcgtttttcaatcatttggaagataagctgtttgttcttgtcttcttcaagatttgctgagagttcatccaaatgaagctccatcctccgaagtacctcatcctcatcaataactccgagattatgccatgccctcatctgtcttgcgagaccactttctgagattgcttcgagttctggccagtgatgtaaatgggaaatgacctgatgaacccgtttttcaatctcatttacagtatcctcaccaaatgcccatgcaaattcttcgagtgtattttcttcctcagctgggagagtatgcagccacaatgtctttttaattttttctatattttttgtgttatgtttatgtgacgacaatgctttttctgcattttcctgtaactcttttaagttttcctgcaaatctgccggaactccttctaatggaaatggcttttgtaatccagaatctaaaagagccgccgtaattgttcgtctgacacagccttcttcaatcaaagatcccattcccaaattgcgaagctgtgtgttaagtccctgcatatgttctgtgatatagaaagcaattccttttttctccagattattcttcagcataagaagcgtatctgccgctgtaatatcaatattcgtgattgttcccgcatccacaattaccgttttcgtatcctcttttaaatgattttcaatatcttcctgaaacagcttgctatttgcaaagaacaggcttgcattaaagcggtaaatcactgtattttcaatcggatgtgcatagtgatttttattcaaatcataaaatccatctcttccaggtatccctccaagaaatgcccttggtggatttgtctcacggataacaactgcaacaaaggaaagaattattccaataattacaccgtaaatagttcccaggaataataccgccatacaagcagccacaaatatataaaattctttgcggcttaccttaaataatcgcactgccaaatgccattccacaacattcatcagcgccgaaatgactatagctgtcagtaccggaacaggcaaatatccgataaagcccgcggcaaaaagcagaactgccaccattgtaactgctgctgtaatcgaaactgcctgcgtctttccgtcaaattgctcattcatcgaagttctggaaatacttccatttaccgggcagctgcctgtaaacgcagagataatatttcctgctgcacaggccaaaatttctttattatcatcaattttgtaaccattttttgctgcaaaattattctcagaaagcaaagtttcggccataacaacaactgcaatcatcaggcctctgcctgccgcgtggcttaaatccacatggaaaatgtctggtaaaataaacttaggaagtcctggctcaacttttgctagcaaagtaactccgtacctgtctacatggaataccattgttgcaatcattcctaatgccataatcacaaccgccatcggaaacttaggcataacctttttagaaataataagaattgccaatgcgccaacacctaatgctactgacacccagttaatatgctgtgctatctcatataagtgctttaataattctgggagttcacccgaaccagacttgccacccatgattttaggaatctgcatcaaaataatcgtcaacgcaatcccactgataaatccgcccataaccggagtcgaaataaatgtaacaagcttgcctgctttcaaaaaataaaataaaagcagccacaaaccaacaaataatgcgataactgggatataccgcagagcatctgcactgccgctctcaattccaagactcgccagtgctgctcccgcaatggccgccggtgccgcatctactccaaaaataaattgcggtgatgtggaaaaaagtgcaaaaaataaaatgggaagcacagaaccatacagtccaaaaactgctggcaatcctgatacttccgcatatcccatagagataggaatagaaaccgccgctatcataatacctgctgcgatatcttttcccagatattcttttttataatttttcaatgtaggaaataaagaactcttcatatatagtatgccttcctttctgcaaaactcaccatataatatagaagattcttgggaggttgtaaagggggatgggcgaaaaccagagctgtgatagaaaaccgtcactgaacactggggactgctataggagggtaatttagtttattttacaaattttccgaacacatttcttaccagcggacctgcaaagaaaatctgccagcaaagtgccattggaaaattaattactgttgtctgtaaccactgtgcgataatctcacttcctggatgtttgaataatgcagttgcgataaagctcatgaccggacacatcaggcagacaatcatagaacagattgcaagtgtaatgaatattggtttatctgttggggatacaatacggaatgcaaggaattttgataatttttcaactacgaaaaattctaaaatagctgcaatcggccacataattggcatctcgtgaaatgcgagtaagaaaatctggttgctcataccacctttatcgattgcgatattgtagcaaaccattgcgtagaccatgacaaaagccatgataattgtaaaaataacgttctgtaactttgtttttggcataatcagctgcctcctttttcattctgtttatcaaaatcttaaatagctgtttttcttaaaataatctttctcattcaaaataaatactttaaattgaggcgtgcagattgctggaatgatttttcaaacacgctctagctatttaaacttcgatgaaatagcataaaaataggctgtgttgttcgttatcaacattttatatgtttgcaattttatatttcatacacctttaaatatttctaaaatatagtactttcttaaaactgcatacctttaaaatattgtgcgtttccaattagaccaaaatatttttacgatatttaatttatttgatacggcttgacattatagcataaagaaaaaatttatgtaagtctttttttatttttttattttgtacataataatatctcattgacattttggtatgtaaattacctatttcttattgacctgtattgactttactcgatgatacctccacatcgttcgctgagtcatcttgttatgaaaaatattctgcattatttagctgaaagtcaatgaagaagtacgcaaaaaaagttaatttcactaattttacagccattttctactactttatagttattatttatacctaataagttccataaaccacaaaaaaagcacatttttttacctttatttcattttatataaatgttataattgttatgtttttgtaaggaaattgtaaaaaagaaaggataaacgtaatgaaggaaaacaaaaacgattttaaaccgtatattcctgcggaccaggtagttccggaatttacagtcacagccttaattcttggtattttacttgcagttatttttggtgctgctaacgcatatcttggacttcgagttggtatgaccgtttccgcatctattcctgcagccgtactttccatgggtattattcgtatcattcttcgtaagaattctatcttggaaaacaaccttgttcagacaatcggttcagccggtgagtctgttgctgccggagcaatctttacgctccctgctttattcttatgggcaaaagaaggtaagattgattctcctagtattttaactatctttttagttgcacttgttggtggtatccttggtgtctgtttcatggttccacttcgtcaggctcttatcgttgaagaacatggtgttcttcctttccctgaaggaactgcctgtgcagaggttctccttgccggagaagaaggtggtaacaaagctggtatcgtattctccggtcttggtatcgctgctatttacaaattcatcgctgatggagttaaacttttccctagtgaaattggttatgatattcaggcatatgccggctcttccgtaggtattcaggttcttcctgcccttgccggtgttggttacatctgtggacctcagatttcaaaatacatgttcgcaggtggcactttaagctggtttgtactcatgcctatgattgcattatttggtaaagatgctaccatcttccctggaagtgaagtaatttctactcttgctccaggatcattatggggaacttatatcaagtacattggtgccggtgccgttgcagctggtggtatcatgagcttaatcaagacttcaccactcattgtccgtacatttaaacaggcaataggcagcatggctaaaaaccgcgctactgctgatgcttctcgtacacagcgcgacttaccaatgccgattattcttggtattatcgctgttattgctgttgccatctggttacttccaattttccctgtaagtttccttggtgcagttcttgttgttatattcggattcttctttgcaactgtttccgcccgtatggttggattaatcggttcttctaacaacccagtttccggtatggcaattgctactttaattatttctactttaattttaaaagctacaggaactacaggaactacaggtatgatcggttccatctgtatcggtagtattatctgtatcgttgctgctatcgccggcgatacttcacaggatttaaagacaggtttcatcgtaggtgctacacctaaacttcagcagattggtgaaatgatcggtgttatcgcttcttccgctgcaatcggatatgttttatatctgttaaatgctgcatggggattcggttctaacgaaattcctgctccacaggctacaatgatgaagatgctcgttgaaggtatcatgaatgcagaacttccatgggcactgatccttgttggtgtattcatcgctatcgttgttgagattcttggtattccagtacttccatttgctgttggtatgtaccttccattctcactgagtgccggtattatggctggtggtgtagttcgctggattcttgaacgccgtaaagcagcaaatgaaaacgaagaaaaagaaaagaaagcttgcattgaacgtggaacattatttacttccggtctgattgccggagagggactcatgggagttatccttgctatctgtgcggtagcaaaagttgactctaagtttgtttcccctgttgcccttccacagattgctagcttagttattttcatcattttacttgcttatttatacttcttatgtgtaaaaaagaacaacaaaactaattaacaattaaattacaaaacatatttcatttctggcagtgagagaacctctttcactgccaaaattatttatacactttacgaactatattctaaccgttataatcatatttacaaatatatgaaaggagtccctatggcaaaacagaaaatagataaaaactaccttgattttatcccagtaaaaaatccagaaataaaatatgaaacaaacgacaagggaaacattaccgtcttcattcgctgggaaggtttctttaacaaaatcgcccagaaattcttccaccgtccaaaagtaagttctatcgaccttgacgattacggcagcttcgtctggaacattattgatgataaaaaagacattcacacactctcccaggaactcgatgctcatttccctaaaatggaaaaatcactctcccgccttattaaatttctcgaaattttgaaagaccatcatttaattacttattcagaaaaattaaaataaaaaagatataaactacaaataaaatggctaacaaaaatcacataaaaaattaagataagaagggagcacccatggaattactgaaaaatctgatacattatctcccctatatcctactctttgccgtagccactatgttaatctacggctggggattgtggcgttccatgcaccagaatcaggatttaaacaacctcctgacctctaagggaatcagccggataaaaaaagaattaaaacgcaatgggaaaatgacaaaaaaggaactctctgactgtgtaaaagacttaaccgccagccagccatttagtaaacagcgaatcggagtcactaatccaaatcagtttttggattcgctgctgccttatatggaacgacaggaaatgataagcaaatctaaacaaaacggcaaggtatactatgatttgattcattaaccaacagacacccacgaagagaaacgataggctatcgtttctcttcgtgggctgacagtgactggatttagttgaattaattagttgaattaattagtaaaaatcaggtgcagctcataacctacatatataaaaggctccagtatatataatatactggagccttttatatcttattatctacaagctacaccgcttattcttcagcagcttcctcagtctcttcttcctctggagcattgtgtacttctgttacctgtacaactgtctcctccggattcgtcttcagatggataccttctgcagttgcgattggtaaatcttttactctgatagtatcacctgctgtcttaccatctaaatcgatttcaactttttcaatcagattttctggtaatgcttcataactgatttcctctaataataattctacgacaccagattttactttctcatgatttaagagtacaacttctgctacagaatgtactttttcaccttttactaatgcctggaaatccatttctacaatctcatgtttcattgcattgtagtcaatctcttttaataagactggcattttctgtccttcaacagtgagaattaactgacttcccttattacaggttcttaagattctttctgcctcttttttctcgattttcagcggcatggagccttccatgttcttaccgaacacattgcctgtaacaaatccttcccttctaagcttttttgccttgatctgcatatctcttttttcagcacttaaagtattcatttgtcttttcctccaaaatgtctgatgcttagaggccctactttatcaggtctgataagtattttttacggttattctttttaaataacctcttctttgttacggtgcaattatagcactgctgtcagaaaaaagattcacaaatatttttattttcaaagaatttttttattaatttttaaaaatattttgtaaatgtatagacaattttaacaaaacattttttctgtcacttaacagatattccataaaacatttttccagacattcatttttactcaaaaggtgaagtggatttagaaaatactttctacaaaatgtgtattatattcatggaaactttcaccaaagcaacagtagttcatcatggactacgtcaactgaataaagtaaaatatcccacaaatcaggaagagtacagattactaattgattcttcaaacaaattctaagactcttcttcaaataattcctgcacagataacagacgaaaatgactctttttcacataaatcaatccttctttggacattttcccaagttctttggacagtgcggaacggtctacgcttaagtagtctgcaagctgctggcggttaaatggtatatcgaattctttactgttacatagtactgcctgattcgataaataggatagcagtcttccccggatagatttggaggaagtgttaaaaattcttcgggacagggcgagatttttctgtgcggaaacctgtaaaagattttttatgagttcattatggaaaatgcaggaattggaacaaaggtggagcatttttcccacatttaaaaataaaatttctgtatcttctgccgcaatgacattaactaacattttctggtctgggatactggcataggtttctgcaaagatttctccttcaccggcccgctctagcacactgcggtttccccagatgtcatcattttctattaaaacacttcctgataaaacaatgccgatacaggatacgacttcaccgacccggtaaatcatttcttcctttttatatttgcgtttgcccgcctttaagcaggacaacatctgctctgtttcttccggcgttgccccctgaaaaagcactgttttcgataatttataaaaatccatattttttctccccgtttgttgtcaaaacaacatatttatcaaatcaactatattatactgcgtatagaaagtcaattaaaggaggataacaatggcttatatcaaaaatatttcacatgaagaagttttacatcttactgaccagatttctgccgataaaggacagattgtcagcaaaactttagcacagaacgattatgtgagtgtgactcttttcgcattttccaaagatgaagaaatcgctacacatgattctaccggtgatgcaatggttctcgttcttgaaggaaccggtcagttcactgttgatggcaaagaatatattttacaggcaggggatacccttgttatgccagcgaaaaagcctcattctgtttacgcaaaagaagactttaagtggcttcttactgttgtatttccttcataatagaatttataaaaatgtactcttaaaatcttttcaatttgattttatgaagttattttttgtcagcttcacttaaattttttagcactatctttttattattaaaaaagttgctataagcaccatttacgtgaatacgttggagatacaccataataccagcctattaagatttaaaaagtatattagagtaaaaaggagattaacttttatggaaaaccaaatgttttgttatcagtgtcaggaaactgccggatgcagtggatgtacccgcgttggagtctgtggaaaacagcccgatatcgctgccatgcaggatttattggtctatgttacaaaaggaatttctgcggtaactactactttaagacaggaaggagtagagattcagccagcagtcaatcacatgattacactgaatttatttactacaatcaccaatgccaactttagcaaagaagcaattatcgcccggattcaggaaacgctttccgaaaaagatttgctcctttctaaactaacaaataaagatgtactcccagaagcagctctctggaacggctccgtggaggaatttgatacaaaagctgcagctgtcggtgttctttctacagaaaatgaggacatccgaagccttcgtgaactgattacttacggattaaagggactttccgcttactccaagcatgcaaatgttcttttacaggataatgaagaaattgatgcatttatgcagcgtacccttgccgcaactcttgatgatagtttatctgtcgatgatttaatcgcgcttactttagaaaccggaaaatacggtgtagaaggtatggctcttcttgacaatgccaatacttctgcttacggaaacccagaaatcacaaaagtaaacatcggtgttggcagccgtccgggtatccttgtttccggacatgaccttcgcgaccttgaaatgctactcgaacagacacaggggacggatgtggatgtatacacacactctgaaatgcttccagcccactactatcctaccttcaaaaagtatccaaattttgtcggcaactatggaaatgcatggtggaaacagaaagaagaatttgaaagctttcacggtccaattctcatgacaacaaactgtatcgttccaccaaaggacagctataaagacagattgtacacaacaggtgcaaccggatatccaggttgcaaacacattcctggagaaatcggtgaagaaaaagacttctcctcaattatcgaacaggcaaaacactgtactccaccagaagaaatcgaacatggagaaattgttggaggctttgcccacaaccaggtacttgcccttgccgatgatattgttgccgctgtaaagtccggcgcaattaaaaagtttgtcgttatggctggttgtgacggtcgcatgaaatcaagaaactactacacagattttgcaaaagcattgccaaaagacaccgtcatccttactgcaggctgtgcaaaatataaatacaataaacttgatttaggagatatctgtggcattccacgagtactcgatgccggacagtgcaacgattcctactccctcgccgttattgccctcaaattaaaagaagtatttggacttgaagatattaatgaacttccaatcctctataacatctcctggtacgaacagaaggccgttattgttttacttgcccttctctatcttggagtgaaaaatatccaccttggaccaactcttccagctttcttatccccaaatgtggcaaaagttcttgtaaatacttttggtattgcaggaattggaactgttgaagaagatttaaaactctttggattctagagcatgtctgaaaaatgctttctgcaagatatgcgttacaattttcagcatactttaaaaatacggcaaatttgatttgtgacgtcctcccccacctataggatgccactgaaaaagtcttttttcgtgtaaatcaatacgaaataaagtatgtttgttaactttacagtgctatatattgtatgcaaagttaatttttcagtggtgtcccttagaggtcggagtcttcttgctagaaaaggataaaaaagaagcaaaaattttctcatctatttttatatttttgataatattttaagatgacatctgtttttgcttcttttttatatgtaatattttttcaagcatactctctcaaaacaaactcattttttatattttaattatattttttatacaattaaattatcaatacataccttttgtccggttaaaatttttttatttctattcttctctttttgtataacaatactacaaattattgtatcatattttttcctttgaaatcaaaaaactacgcttgcaaaacatttttatattactttatttattgcttatttccaagacctctgctataataaactatacttttatataactttcgtaattttttatttcaaaagaactacggcaaatttaagaaaggatgttgaggaacaaatgaaaaaaagaatctacaaaaatcttttagcactgactcttgcttgctccgttgcattaagcaccgcaccagtttcttcattcgcaagagacgttgctgcagtatctgagagcgaagctactacagaagctcctaaggagaaagcaactgaagttgaaaagaagacagaagtttctaaagacgcaacaactgtaactgaaaaaacagaggcttccgaagagaagactactgccgctgagaagacagaagctcctgaggagaagactattgctgctgaaaagacagaagcagagacttctgaagagaagactacttctaaaaagacaaagacttctgagaaaaaggctacagacccagaatgtgttaaacctgacaagccagtagttgatggtcctactccagaaggaaagaaggatacagatgaggctacaaagccttctactgtaacattacacttcaatcagtctatgccaggacatgttttatctgtcagcaaagcaagcagctttaactttggtggatatgcaagcgacaaaaaagctactgtaaaggcttcttacgttggaatagcttggaatggtaaaggatactcttccagcacaccttcctacaaagcaggaacttatacagaaactttatatgttactgacgcagcttactctgctacaccaatttcaagaacatatacaatcacaagagctaacactcatattatcatcaacaatccagtagattgtacatatgatggttctgcatttgctgtagatgcaactgtatacgatgataataacaatgaagttactaaagctaacgtaacttacatcagagttgatggcggcaagtatatttacctcggattcactgctcctgttgaggcaggtgcatacattgcaatcgcaacgtatcctggagatgcaacacaccgtccatctgctgcaaaatcattctttattattcatccaaaggctgttaaggttaacatcgactataaagaaaaatacgttggtgacaaagatcctgaacttacttataaagctgagggtgtattagatggtgattctcttggacttaagcttacacgtgaagctggcgaagaagctggttactatgatatctacccagatacatcttctctcaatcctaactataagttagctgagactcctgatggaacagatcatttccatatccttaagagagattctggagaaactcctaacccaggtacaacagaaactcctaacccaggtacaacagaaactcctgacccaggtacaacagaaactcctgacccaggtacaacagaaactcctgacccaggtacaacagaaactcctgacccaggtacaacagaaactcctgctgatgactcatccgccactacaactgaaactccagcagacgactcatccgctactacaactgaaactccaagtgtagatccatctgaaaatacagatcctactacaaaaactactaagaaaacaactacacagaaaaaagcaaacactaaaaaagcaactactaaaaagaacaaaaaatccaaatcatccaaaactggtgatgcttcaaaccctgttctttacatggttgtaagtgtatttgcacttgttatgtgtgcatttatcgttcttcgtcgtagaactgacagatagttctgacaactgaactaattaaacaaactaactaaacaaaaccctcaggattttctaatcctgagggttttaaaacatcattcataaaattggaggaaacatatggaaacagctcagaacaaaattgtaaaagccgctttattaggtgccggtactgtcggcagtggtgtatatcaacttgtccaggaacgtcaggaagatttttctcatatttgtggtacacaaattcaaatcactaaaattcttgtgcgtgatgcctcgaaagaacgagaaggtatcccttctccccttcttacagataactggaatgaaattattgaagatgacaatatttctattattattgaagttatgggtggtattgaacctgcaaagtcttatttgcttgaagcaatgaaagctggaaaacagattgttacagcaaataaagatttaattgctgaacatgggcatgaacttttagattctgccgaaaaatatggctgtgatttcaagtttgaagctgccgttgcaggatgtgtcccaatcattcaagtattaaaacaaagtatgtccagtgaaaatattactgaagttatggggatcgtaaatggtacaacaaactatattcttacccgtatgacacagagtggtatgagctatgacgaagcgttaaaagaagctacagatttaggatatgctgaagccgatcctactgctgatgttgacggtcttgatgccggtcgtaaaatcgctattatggcatccatcgcattccattctcgcgttaccttctctgatgtctatattgagggaatccgcaatattaccgcaaaagacattttctatgcaaaagaatttaattctgtcatcaaacttgtcggcattgcaagaaaagatgaggacggcatcgaagtaaaagttcttccaattttaatcccacaggatcatcctctggcaacagtaaatgattcctttaacgctgtatttgttcacggaactgcatccgatgatacaatgtactatggccgtggtgcaggcaaacgtccgactgccagtgcggtaaccggggatttatgtacagttgcaagacatatcgttgaaaaacattctaatcttcatgtctgctcctgctacaaagaacttccagtgaaaaatattcaggatacttattcccgtttcttcctccgtctgcaggtagctgaccgaccaggtgttcttgcgaatatcacaagcgtattcggaacaagtcaggtaagtatcgcccagattattcaaaagtcccgccaaaatggcaatgccgaactggttattattaccgatgaagtaaaagaactgtattttaccgatgccttgaacattttgaaaagactttccatagttaacagtatttccagtctgattcgtgtatattaagaagattttacgttcatttctcataaataccttgaaatacccgttgacaaatcaatcgaaattattaaaatagaatggtaatactaattttaacccaaggaaataggaggacttattactatgcgaaaaaccaagattatctgtacccttggaccatcaacggataaaggtgatgttttagagcagttaatgctctctggtatgaacgttgcccgtcttaatttttctcatgatacttacgagaatcagaagaaaagaatagataaagtaaaagctttacgcacaaagcataaccttccggttgcatgtctgttagatacaaaaggaccagaaattcgtcttaaaacatttaaagacgaaagagttactcttgagatgggacaggacttctgtcttactacaagagatgtagaaggaacaaaggatattgtcagtgttactcacaaagatttacacaaagatatccatgttggttccagcatcttaattgatgacggtcttgtaggattaaaagtagtggctatcaaggggcaggatatccactgtaaagtagagaatggcggaactatttctaaccgtaaaggtgttaacatccctggtgttgaactctccatcccattcatgagtgaaaaagataaagaagaccttttattcggtatcaaacaggacgttgacttcgttgcagcttctttcacaagaacagcagacgatatcaaagaaatgaaagcgttcttaaaggcaaacggtggcgaagatatccgtatcatcgctaaaatcgaaaactctcagggtgttgataacatcgactctatcatcgaggcctgcgaaggtatcatggttgcccgtggtgacatgggtgtagaaatccctgaagaagaagttccaatcatccagaagatgattatcaaaaaagtaatcgcagcaggtaaagtagttatcacagctacacagatgctcgattccatgatgaagaaccctcgtcctactcgtgccgagactactgacgtagctaacgctatctacgacggaacaagtgctactatgctttctggtgagacagcagcaggtgcttatcctgtagaagctgttaagatgatggcaagaatcgctgaacgtacagagaaggaaatcaactaccgcaaacgtttcaatgatatggctaaatacactgacccaggtatcacagacgctatctgccatgctacctgcagcacagcttacgacctcgacgcaaaggcaatcatcactgtaactaagagtggtttctctgcaagaatgatttccaaataccgtccaggatgcgacatcatcggatgcgctatggatgagaaagtatgccgtcagttaaacctttcctggggtgttcgcccaatccttcttggagaagaatgggaagtattcgtactcttcgaacgtgcaatcaatgcatgtaagagagatggactccttgaaaaaggtgacgttactgttattacttctggtgtaccaatcggacgttctggaacaacaaatatgttaaaagttcaggttgtagacgattaaatactaatttgatggggagacagacgccgctttagcaaaagatattgagctaaagcggcgtctgtctccccggcaattagtatttaaatttctgaagatttacagctcctctatcatacaggtatgatgtttttctgagtcataattgattccaactaagagaatctttccctgatatccggacaaagctccctggtagcgtttttctttaatctgcttgagcgctgtttctgcggattgattatactttaattctataatcatcgcaggacggtttcctgcatttgctcttggaagaaagacaaaatcagcgaaaccttttcctgatggcatctccctaattacattgtagtaagcgggtgcagtaaagtatgccattgtgaggacacagctcaatacattctcatcattgtatttcaatatggatgtatatgtttcatgcgcaagtccaataagttcagccactctttcggcattaccatcaattgtttcatctaatagttcatcacacttagaaattgattctgcaatttctttccatgaacctgtctgcaatgctaattcaaatgccgttgccacctcataatttggaataaatgatttctttctatctgcatcatatccaagatatcccaaatgaattaaagctgttaatgcatcatcttttgacgttattatagaaaaatcattttggaatgtatttgtatttatgcgaactttaccaccagttaacattttcataacatcatcttttaacccagcataattcatggtgataaaggtatttattgtatcaaaagcagaggtatttctccagtaagaatctattttatgcctttctaatgcctgtgatacagaattaggattatacatatgctctccatcaatcagatacccattataccatgctttcactgtttcaaaatccatactataatctttacataaatctttaacttctttttcagtaaaaccatagtattctgtaattggataggaatctaacatcgtatattcctgaaaattatttaaagcagattcatcttttatcttcttaattggtaatattcccgtgatatatccaagtgctaaaaagcttttcgattcttctgacttaaacaaagaatgtagaaattgcaaatatttgtggactaaagcctgatcgtggctatttcggataacacaatcccattcatcaatgataataacaaatggaattcctgtcagcaaataaatatcctgtatcagcaaataaaaatctctcttatagtttaataaatccccatatattttttgaaagtcctcacaaacacgttcttctatcgattctattaaatcttctttatgataatcccaaactgatgaaatatccaaatggatcacattatatttatttcgatatttttcatagtctggatctgatgcaatcttagtattttcaaataattttgaggaatcactacccagactatagtaagcatcgatcattccggcagcatgggacttaccaaaacgtctggcatgactaacagcgatacattttccattcgttcctaattttttgtttaaaaattttaaaagttctgttttatcaatataaatttcactattcttatcctgtgtaaaacttccattccccggattaaaaaatgtacccattttctccctcctgttctttataaatacttctattcatagtgtatcacatttttgtaaatctaaatactaatttgctatttgttattaaaaacagacaggcgctgaaacaaaattttatgctgaattgtaagaatactatgataaagaaaaaagaatggttataagtattgcattttatgactttgcgctatggaattctgaccataggaacttgggactcgtttttcccaagttcctgtttttctgggcagaatggaatgcttagcgcaacggaacaaaatcaaacttataaccattcttttttctttagaatactccatacaattcagctcaatatcttctagcagagcggtgtctgtgtccccatcaaattagtagttatcttttctttgtttagtttttctcctattactatgaagatttcctgtcctttttttatcgattgtatagtaatattttgatgtgtggcattaagttcgatccactgatctggttttgtctgcataaagccttttattcggaagatattcccacattctttgtcgttaaatatttgttttactttttcttcaagtttctctaccggcatagttaaattcataaaatataatgactgaaatgcatcttcttctgcaatgtcttttttctcataatctgcaccagcatagcctgctgactgaatttttttaaaatctgcatcagaaagtttattccaatctttggcaaagatttctttttcaaatcggcggtcgcaatggacagattccattgctttattaaggtgtgcttttgtgcgctctatatcgatttctgctgcctcctgcgctttacttaataaaacaatgcctgcattggctacttccgatgcaaggatgaattctgcgtcttctgagaggttctcttcaagcattgcatctacaactgtaattacatttcctatttcataccatctgtcaagcggagattcatgaagggcatcgaagaattcgtccatatcgaaaattccggacggctcgatcaatactctgtcatatccgcacattcccattgcaataagttttgtgcgaaatcttcttctatgacaatctttatcgcatccacctgctaccatttccaatgtacatttttctcctgcaatgtcctgaagtaacatcatatcgacatttactgccccaaaatcattctctaatataccgatatttaatccctgatctataagatactttgcatatttttttataaatgtggtcttacccgaacctaagaaccctgtaattaaatctatttttaccattttatttttcctcctgttttggcaaagatattataacaaaaaaatgattttgattctatgacaaaatacatagattaaaatcatttttataattctgaacttttataggattttacttgattgccataagataaatattgaaatttccgcgaactctagtgtataattataaagtttaataatgctatgtacttcgggattcttcacatccttacttttgtgagaagagtctgtgagtgcattataaaaaacaggaggttttataacatgcttcgtgatgattttgacttacgtttaacaaatgaattaatagaaacttatcttaaaattgcctatggaatcaaacctggatgctggcttgatgctgaaaaaggtcttcttcaggaaaatacgctctatcctaagttaaagcaaatgatcaacgatggcaatattaatgatgcagaagatattctatatgaatatgctaatccaattaatccggacatattaaaagtcggtctgttcttctattatgatctaaaccgtatggctgatgctgaacttgaagcagcagacttcactcgtgatgaagtaaaagaaggcgtacaggaattacttaaaatctacgatcaggaaaactttggaacaatttttcgttagaaacctgattctttcaggattaatttatgttcttcatgctgcaaaatgccgcaaacttataattaatcctgcatttctgacatgtgctttctgtaccagagcggtataagattgcgctgacatacgggattcttacgttctttaatcccaatcgtctgaaagaatgttttccacagtgcagtcatactatcggtatcctttgctgcagattctcttgccaggaattctgacatttcttcttcggaaagagatgtcagataatatggctggtctgccggatgtaccactgctgttcttctattatcatctataatcatccagtcttcagaaggtaatctatccacaaaatgtggtgcaagtaaggtaacgacatcacatttgggagaaattatccccacaagtatgtgatgattcatctcggtaaaccgaatacattcccgaaatatatgtgcttcattacttgcttttcgttctaactcaaatattttcattacgatcggattctgtagcgaatcgagaatcttcctgccataatggaatcccaatattaaaaaacgataaatactatcaagcttctcctcttcatctgctgccatcgctgcatgatataccatctgatatgcatgaaaggaaatcttttgctgaatcgttcttatcacactctctgttttctctttatctgcctccacatgacggtattcacaaaaaagttccattgttccaagcggctctgttcttaactttatattgttatgtccaagatgggatgcccacgcttcataaatacaggtcatcatatcatcaaatctatctttacatgtaaaaactaccatatcatttctgctttctttaggtgatggggagttcacgtcaaattaaaatcatcaaataaagataactgtctgtatgttgttggatgctctatcttccagttatctttctgattcgtcccaataagctggcgggtaataaagtcttcttctatcggtgtatgatacttcatcttacctctgcaggttataaaataaactgcccgctttaatacaactcccatcttcttgatatcttcaaaatcaagtgccgcctgtcttcttgccctgacaattcgccctgcggacttattccctattcccggaacacgaagcagctgttcatagcttgcctgattaatctctacaggaaagtattctagatgtcgcaatgcccagtcgcacttcggatctataaatgtattaaaattcggccggtccgaacttaggagttcatccgcctgaaatccataataccgaagcagccaatctgcctgatataaacggtgttccctcaaaagagggggtgcggttccaattgctggaagttccggatcattttgtcgcctatttacattatcattcttcttaacagatttctgcgcatcttccattatagaaaatacagacttctcctcaacagaggaagtattcttctcattaaatatactattcgacaaatattgatttcccttcgcccgctccattcgtctatccttaccaagtgctactctctgcgtctgtattcctctctgaatctgctgaatcggccgaatcagattctttggcttcttattcggtgccagtctcttcaagccttcggcagtaggtaattccagattcacactcattctgtctactaaaaatccaagtgcatatataatatcatccggtgcccctggtatcgccttcacgtgaatataaccattaaaatgatacttattccgaagcatataaatcgcctcatacattcgctccatcgtatatgccggactcttcaccaccgcagaacttaaaaacagcccctcaatataattccgacgataaaactccaccacaagcctgcaaatctcttccggggtaaatgttgctctttccttctcgttcgcagcacgactcggacaatacttgcagtcaaaaacacaatcattactaaaaagaatcttcaaaagagaaacacaccgtccatcggaagaaaatgtatgacagatatccacagataccgtattcccgagatgccccttcttccctcttcgacttgacccactcgaagtacacgcaacatcatacttcgccgcatctgctaaaatctttaactttctctccaaaggaatctctctttctgtcatagtatcacctcttcataaacatatgttccgaaaatttgtttgtgtacattctaacacacctctcctacaaaatcaagaacttctgatttgccgcaggcaagaagacgcccccaaagagagacactggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgaggctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatattttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgagcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccacactaccctatatttgtgactttagtcgcagatatagggtagtatctctctgggggttcgtctgtttattcaccccggcaaattattattttgtaatattctcttgctgttatactataaattatcacatagattactgcaaataccgctactgttcctactgtatacatgaaaaataatgatatattcgtaaggtttaacacactgagtagccttgtgataattttaaaagcaaatgccagatgaatgactgccataatcagtggcaggaagaagacgagtagtacctggcttcttatggactgtctgacttcttttttgctcattccgactttttgcataatctggtagcgttctctatcatcgtaaccttcagatatctgtttgtagtagatgataagcacagtcgccatgaggaagatgattccgagaaatatgccgatgaagagaaatcctccgtagaagttataaaagttttcccggcttagttctcttccttctataaatgcagacttaaattttgcctgaagctgttcttgaagaatttgttctgttctttctcgattggttctacttccatctaaattaaagctatagacatattgcatgaattcatgataatcttctacactatcctccatatcatcttttccataaacagcttttaaatactttttaataatattggtatctttaactatgacataccatccatcgacggaatttgttgcatctgcttttgcaattctcatactatctaaatttgctgctactttataggaatcattatttaaatgaacggtttcttcattctttatgctggatttatttttattttttctatggtagataagtacttcattatctgcaagttttactgcttttccttctgtcttattataatcagaaagcggtatcataacaaactcgactatgttggtatcgccataactttgtgctgttgtcatattgaagtttttagttttgtcattatataatgcagtaaaatttccttcatgaaaacgtatctgtgaagttggatttgtatgattttcttttgtaatactagctacgagttccccgatttgccgttcttcattttggttgattccctgatttgtaatttgggcttcagatggaaaacgtgttactaatacatcgttcattcctgcatatagagaaatagtgatagaaaccataacaagtaccatcgtgcttaatatacaaatattcgcaagacctactgcattctgtttcattcgataaatcataccagatatggctgtaaaatgccttgtcttataataataactcttttttttacggagtaactttaataaagtgatacttcccgccataaataatgcatatgttcctgcggcaactaaaagtacggcaacaaaaaactgacctattgcttgaagtggttcttttgttgtaagtgaaatatagtaaccacctgctaaacaaacagatccgatgattgtcatcagccattttgtttttggttcccgctccccagcatttcctcctcgaagcaattcaatcggatttgaaagcttcatctgcacaaggttatacagaaaaattacaaagaaaatgcatccaaaaatagctgccgtaattcctacagaaactggagaaatcatatacacgatatctcttttcaaatggaggattttcaataacacaagatacacaagttttccaaaaaggattcctgctaaaatgccgccaataatactcactgttgttgtaattatagattctataaatagcattttggcaagatgtccttttcccatacctaaaatattataaattcctaactcctttttccggcgtttgataaggaaactatttatataaaacaaaaagataaccgagaaaataagcaatactacattcgcataagaaagcataattgatagggttgcacccgtttttacgagggagggatttcgatataaactatccataatgaaatacatcatcacagaaaatgcagatgctaaaatatatgggagataatttttcctattattttttaaattcgttactgcaagctttccataaattttactattcatcatccgcacctcccgctgtgattgcagtcatcgcatcggaaatcttctgatacatctgtgtctcgctgaggtttcctttgtaaatctgatgaaatacccggccgtctttaataaataaaacccgccctgctgtgcttgctgcctttacactatgtgttaccatcaggatggtctgtccatcttgattcaaactggtaaatagctttagcagttcttttgctgccttagaatccagtgctccggtcggttcatccgccagcagaagctgcggctgtgtgataactgctcttgcaacggcagctctttgcttttgccctcccgaaacttcatagggatacttctccagcaagtttttgataccaagtttatctgcaagtggaagaagtcttctttccatttctctatacgatgttccggaaagtacaagcggaagaaaaatattatcttttaaagaaaaggtatccagaagattaaagtcctgaaatacgaatcccagattattccggcgaaatgccgccatctctttttcttttactttgcttaaatctttttcttttaaaaatacttttccttcggtcggcttatcaagtgccgctaaaatattaagaagtgtactttttcctgaaccagattcccccataattgctacatattcgccctgctccacagaaaagtttacatcttttaatgcttccacctgatttccgccaaagcgtgttgtatatactttacgaacattttttacatctaataatgccattataattccctgcctttcttcttctctagagcgtgtttgaaaaatgctctaagcttacaggtttattataaaaagaaagtgccgctgcttccatcgaagtacctaacactttctgctcttaccttacatttttgtaagatatatctttgttcctcttcccacttctgaatctgctgtaatattccactgcaatttatccataatatttttacataaatacagaccgattccggtagacttcttgttctctctgccattatatccagtaaagcctttttcaaaaattcgcggaagatcttctgccggaattccaattcctgtatcttcgattacaagagatttttctttcatataaatagaaatctgtcccttctttatatatttcaaggcattcgatatgatttgctcgagtacaaaaataaaccatttttcatctgttactatacaagcttttgtcggtttaaaatccatttttatctttttagatatgaaaatctttgcgtattttcggataacctgacacaccatatcatctaccgcatactgtttaaaagataaatctgaagatatgtcttcaactcttagataatttaatgccatctccacatactgctctatcttgaacagttccattttcatatcagaaacaggtattgattcctgaataatttctaaccgtttatttatccggctgttcactatatcttcttcatataaaaattgctccgtattttgcaataaaatatccaatgcagcaatcggtgttttgatctgatgaacccacatgccataataatcaagcagctctttttttgcaattcgattcttagaaataagctcctgctttgcctgatataattcctttgcaagttcctgataatcatattcaataatatccatatgctctgggagttgttctgcatcgtcaaaaaactgctccctgttgatatgtaataacttatgccgtttataatatttgtaaaaatcaataaacagacatactgcacaccacacaaaagacaattcgcatccatagataatcgcatcaaaaggaatatcatataaataaaatagtattccaaatatcacaacgattcctgtaaatataataattggcattttgcggattttcaaaaatgaaaaaatactttctttgatcatttctctttctttcctctatttatccaaataatacccgattccttttttcgtcttaattcgtccttccatacctgcattttctaacttcttacgaagtcttgccacatttactgtaagtgtattatcatcaataaattcgtcactctcccacagccttgcgataatatcatctcttgcaacaatctttccggcattctccataagcatctgcaaaatacgaaattcatttttagtaagagatattttctcccccttataagaaagcgaagcatcatttaaattaagaagcattccttcatgctctaacacattgacattgccttgaaaggagtaggcccggcgtagtaatgcctgtaccttggctgttagtacatttagatcaaatggcttctcgataaattcatcgccgcccatattcattgccatcactatgttcatattatcattcatagaggataaaaacagaattggaacactcgatattttccggatttcctgacaccagtaaaatccgttatagaacggcaaaccaatatctaaaataacaagctgcggatcaaactgctgaaatgcttccatcacacatttaaaatcttctatctgtttggtctcataatcccaccgctccagatgtgctgccacattcgaagcaatcgtagaatcatcttcgacaattaaaattcgatacatttttcctctctattccttttagtgtatgttcaacaaaaattcttgattataccgactttgttgaaccgttaataagttacatatatctccttaaaattcttttttaaaatacttctctgtataatgaataaaccttttcactatttccggaagaaaagattcatttttatagataagatataattccctgcaaaattccttttccggcaatctataaatcaatatctttccagactcatgtaattctcttatcatttgatatgacaaaatcgaaattcccattccagcttccacacaatctcttagcatctctgcactatcaaaggttgcaataatgtttaagtcttcttcttctattccaaaatacttcaagctgccgagtgcctctttcattgttccagagtactgtcttcttgctaaaaatggtgcttctaaaatctgtcttaaatcactctccccagaatcactttctccggcaaaaatcttctgatactcctttgtatttggtgctgccaaaaccaaatggtcttttatcagtggaatgtacttgcactgcttttctacctttgtcccaacaaatccaatatcgagacttccctcttttacccgacgaataatatctaaactatccgcactcgtcatctccacctgcgtatttacatttttctttaaaaatccactcaatattgtaggaacaaaccactgtgccggaacagaagatgtaccaatccgaagaaactcacttccattcccccaacttccattattgctttccgatgtaaaagtaaaatatctactgcatacttataaagttttaccccatcttctgtcaattcaaaatttcttgctgtacgtcgaatcagctttttcccaagctcatgctctaaggctgacatatgtgtactgactgtagattgcgagagatgcattttcttcgatgctgccaaaaaacctttacattctgcaacatttgcaaaaatctgcaattgatgtatatccattttctcactttcctttccggtaagtttaaaatactctggtcgaaaacactccagaataaatatattttaccatatctatcgtttttatcaataatcctatctatattatcgaaataatgaattttactttctgtacaatatctattaaactaattttagaataaattacattatgttgggaaattttatccaaaatgtactcgcaaaatcggttacaaaagtaaatgtatgaaaagttctgaaattacattgaagaggaatcataaaagtatttttcagtggtaacaagcacatacataaaaagcactgagagtacatcccacataaaaggaggctgcctattatggaaaaagaaaaactattttgcaagggaggaggatgtaccgctaaacttggtgccggtattttaagtcgtatattatcgaagctaccgcagggtccggaagatgagaatcttcttgtcggttatgacagtaaagatgatgccgctgtctataagatatctgatgatattgcttttgtacaaacccttgatttctttcctccgatggtcgatgacccttacacttttgggaaaatcgctgctacaaatgcattaagtgatatttacgcaatgggcggtgaagtaaagaccgccttaaatattgtctgttttcctgaaaaaatggatttgaacattttaggtgaaattatgcgaggcggtgccgaaaaagtaattgaagccggcggaacacttgccggagggcactctattgctgattcggatgtgaaatatggtctttctgttaccggcatcgtcaatccgaataaaatctatacgaataacggggcgaaaccgggcgatgcactgattcttacgaagcggcttggtgtcggcattatctgcacagcaaatcgagtaggagaagcttctgtggaagcaatgaaagccgtaacagactccatgacaaccttgaacaagtacgccgcagagtgttgcaggaatttcgaaatccatgcctgcacagacgttacaggatttagttttctaggccaccttcatgaaatgatggatggacagctttcctgtcatattcacgcaaaacaggttcctgtctttgaagaggccttacgacacgccgatgaattccttttaactgctgccggacagaggaaccgaaactttaccggtccatttgttcaatttaaagatatcccatttgcaatggaagaaattctttttgatcctcagacatccggtggtctgctcatttctcttgcaaaagaagatgcacctgctcttcttggcaagttaaaagcttccggtcttcctgctgagattgtcggagaagttttggaaaaagcagaaccagaaattttagtcacgaattaaatgacttctacctatttagaattttaaaaaacacaacctactcttagaatctttcttacaaaataaataccagaatgattcatagaacatatcagatgtgcagtaaaagtatggcttcattgcatgacgcacatcttgcagcaagaatgccgagacattctttacattctttataaatatacaaaatggaggaaccatcatgattaaagtaaatgcaataggcgatgcctgcccaatccccgtagtaaaaactaaaaatgctatccgcgaattacagggtggagggacagttgagacacttgttgataatgaaattgccgtacaaaaccttacaaagatggcaaaccagaaaggatacgatgtacattctgaaaaagttgctgataatgaatttaaagtcacaatgactgtaaatgcagaagcggcacagattgccgctaataatgctgtgtcaacaatagaagaagaaagctgtccgatcactccgttaaataaaaaaaatacggtcgtagttatccgctcaaatcagatgggaaacggcgaagaagaacttggaaaagctttattaaaaggatttatctataccttaagccagcaagatactcttccttctactatccttttctataatagcggtgcatatatcacttgtgaagactctgcctctattgaagatttaaaatctttagaagcccagggtgttgaaatcctcacctgcggaacctgtttaaacttttatggcattacggataaattacaagttggcgaagtgacaaatatgtatgtgattgcagaaaaaatgacacaggctgacttaatcgtgcagccttaaataaaggagtttgcctatgcttagaaagaaaaagcctgcattcatcatcgcatttgacgcaaccacacaggcaatggcaaccgataaactctgtgcaaaaaatggtcttcccggacgattaattcctgttccacgcgaaattaccgccggctgtggctttgcctggaaatccgctccagaagataaaactattttaatagaagcactcaccaaagaaggaatcgagtgggcttctacacatattttagaaatttaatttataaacattcaactttatcaatctatttttcagaattcatttttatcaatatgtcatattttaggtattccaattcgtcaatatctttacaaacgacatattgataaacttgatttctctatatctagtttttattgattaagtgctgttgataaagaaaaaatattcaggatacttattatgaacaaatattttattggtattgatattggttctacctgcgctaaaacagttgtcatgaatcatgaaaaagagattctccaccgttttttacagccaactggctggagcagtgtagatactgcaaagcaaatacaggaaacgctcatggaaaagggaatcctgccagaagaatccgttgttgtcgcaaccggatacggtcgtgtctctgttccttatgctgcaaaatgcgtcacagaaattacctgccatgcaaaaggagcctgctatattcataaaaatgaaaatatgctcctcattgacatcggggacaggatacgaaaatcatccgcattgaaaacggtatggttaccgacttcctcatgaatgataaatgttccgccggaacaggccgattccttgaagtcatggcaaatacattatctctaaccccacaagatctgtgtgagcttgctgcaaaaggcagcggaacttctatcagctccatgtgtactgtgtttgcagaatctgaggtaatcagtttgatcggacgtggagaatcaagagaaaacattgcctttgccgttatcgactctatcgtacaaaaagttgtatcacaggcagcaagacttacaaacggacaagaagaatgcatttgtcttactggtggattgtgcgattactcttatcttaaaaaatcgctcggagaatctttaaaaacagatgtattaaccgatactgacggtcgctatgccggagcaattggtgcagcgctttctgccaccactatctgaattacaatctatgagaatgattaaaggcggattaaaatattatatcttattcgaaaactatgagcagggacttgcccttcatgatgtcttagattccgatgacattccaaaccgaattgccccggctcccagagccattcagggtaaattatcctgcggtatgtcccttctcatagaacctgctcacatagaacaagtacgactttccattgaaaagcaccaagcagaataccataccatcgtacccctcgaaggacaggtaaaaccaaagcgagataaatattgttgaattactatttttttagataacagaaaaaccccagaaacattagtttctggggcaaatcttacgcttgaacacaagtaccttgcggtacgatatatatacaaaaacttattacaacaatttccatttagcattatcaacttgcagactataaccacaataggaacaacaaccgttattatccggaatatagttagccccacaacttggacattccttttccatcacaacggcctggcctttggacttgattcgattcggataacgagatcggcaaagcttccagttatgcttttcacttttcgtcacaatatgcttattattttgaagaaaggtttgcttcaacatcgcttccacagaaatcgtcgtcttgtcagacgtattttccacaccttttagctttatattattaacactgtaagaaagcagctctggggtaagaagtgttttgtacaacgcttcattgatattacttattaaccagccctcatcataacggacaatctctttctcaagattctccagctcatctattttccttgctctgatccaaagaagactcagactcagtataattgtaagtgtcatcgcaacaccaattgcaatatacatattcgtgatcaaataaacacaaggaaatgtcggtaaaaacgaaagtaaaatcgttacactggtatactttagattatccatattcggatctggtgtctgataaatcataaaatcttcgatttgccagtcatagaaattactctgaataaaccctccacaataaggacagtttgtctcatcaccttttaactgtatctgtgccccacagcttggacaaaatatttccgaatactttgagtaaaatctctgctccttctgcctgtctttctctcccacttcattgtgacgaatatgacgagactgccgaagcaatatcgacccatgcggataaatcgattcatgaattaccttaccactgtctctatgtaaatatttatcagaaacagcggcttctacgataacttccctccattcacgtcctgaatcactccaatgccggaagtctctctttttggcattctcttctgataacttcacattcgtaaaatgtagctgccttgataaacctcttccttcaagcagctttacttcatgcattactttttcttgaaaagtccgatccattcttactgtactcttttgcaaattaccggtttgcatcaaagtaagcagctcctccagaacattcgatatctttttcggtactttctccgttctcaaagacttcgcttccggttgtgccaatctttttttcaccacaaaataccagttacttggcaaaaatcgttcaaaattccactccagtatgcggcttgcaacaatataccctaatgcacaagcccacacaaatgcaaaaacactcgcctcactccatgtaagtttcatcaaaaatcacctcctcatatatccatagattactacaacaacatccttttctccatgctcaattcttctacttcttaggcaaataccgcatatccgataccgtatatactgtaataaatgcctctggatcttcctgattgatatacttcatcaatttctgatactcccctttgtctacaatggtaatgatctcatttcttttttccatattataagcaccaatcgcttcgtaaatagttgccccactgtgcagatcacgaacaataaactgccgcaattcctcttccttttttgtaataatacagacccgtcgtttgatattatgatcaaaaataaaatgatccaaaacaataccattaaaataagttcccaatacactgagtactacagttttcttatcataaaccagcgccgccgaaagtgccacacacatccccgacaaagacatcgctttccccagctccatatgaaaatatttatttataatcttagctacaatatccaatcccccagaagaagcattccggttgaataaaatactcagacccacactcactaccagaatgtaacaaagaacatccagttcctgactattcgtaatagaaccggtattgggaaaaatgttctcaaatatacccagaaacactggcagcataacactcgtgtaaactgttttaagcccgaattcctttccgcaggtaaaaaatccaataattaataaaactacattaagaatcatcgtaatcgctgataatggcagcggaacaaaattcgacagaacaatacccagacctgacatactgctaatcgacgtatgactcggaaccagaaaaaagtaaacagcaacagctataatagcaattgcgatggtaaggatatttatttctatcaaaatagacttgtaatctgtcttcgttttcatattatttttttatctcctcctgtgttaaagactattactgcatgaataaaaagtataattgagccgatgattaaaaacatcatttcccttcatttatttttcttattgaattttggaactgtcaattcgctatacatggtattaaataattctgttagaaactgcttatttttaatagctcttatgtctctatttgcgctcaaatccaagatatcttgtcccttgaaaatttaatgttccagcatctccttctattagcattccatactcagaaccactcatagaaaattctattctgtcaccgctgtctacctcgaaagttacataataggaagtggatgaggtagttctatatccatgagagccgctcatgtccccattattaggatgttgatgatgggagacttccgttcgtttggcaactaccctggctgatacattgagccgtggagagtgattgtttttattccatgtggtaatacttgtgataatgccgtatgctaatatgataaaaacgctacaaaatattagtgcgaaggcgatgttaaatagcatatcaaatccataaaataacatagtgtttctccttctcatattttctcctcttagaaatatgtgttttacgataattttatcatacagcaattataacttcaaataggaatttgcgaggtgagtaaacaaacggcccagcaaattcctatttttccacccaacagaaaaaccccagaaacattagtttctggggtgaatcttacgcttgaacacaagtaccttgcggtacgatatatataaaatctagtattattcagttactaattatataagttcgtgattactcgatgatagaagcaacacgtcctgatcctacagtacgtccaccttcacggtatcagaatgggatattgcagaacgtaagtggttatttttcgtttggtttatgatgaaaaatgtgaattttttgctgattccatggggtttgggaggattttgttatcagggtgttatcgcacatcactcttccattccttccctttttgtattaaatgtcaataacatatccattaaaacatctataaatgcattatcaagatctttcaataattcatgtgattcattatttaatatatacatattatgcactaataaacatcttaccgaatacaagttttctgccattgtactacacgttttttttccgttaagttgtaaaagttttttacaacaatcatttaaaattgctacatcttccccggatatttctacataatttgaaaatagccacttcactctttgcttttctaataccatgtttcccaagtcatcacgtttatcaaaaagagaacccttattgctcgtcaactgggcaacaaattttttaaacttatcttcaaaaacaaccgaaatcaaaatttcaataatttgataatatgtatgaaactttgcaaatgcttcttgattttttggtacttccttttcaaataacgtatgtatatattttatattacgtaattccctagatattggttgaagattaattcttttattagctttttctatagtagaatacaaatttcctttttcagaataagaatatcctttttgatataaactaaccgtataatcttcaagctgaaaattattaatttttttagtattctctttatctaaaaccaaaattgtacttgtatcatcataaaaatctgacaacactactatttctgaaaatttctggttatagcagtttatattttctaagagccagcaactcgcaacataggcatatctaagaaaaaatttattttttacataatcatgctgtctagacattaacgcctgtataggaaaaatccatcctatcctttcttttgaagcatagacctgataaatactattttctgaataatcttctctatcatttcttaataaataatattcaaaatctctcggattatattctgcatccagatttaatagaggataatactcacatattactttattttctttatccttcatttcaaagatattttctgtgtcattatattgaaacgatacacattcaacctctgcatcaacaaatttaaaatacattattatatcacctggctatagtatttcttatatccattttgaactgccgcttctaaatctaaataagaatcactttctgaatttaataattctctaaaaaaatattgaaaaaacattctctgagcatttccaattttcttagaagatacttttattctatctagtttgtttaacagctccatcatccagacatagcctttatttttttcttccaatttgtctactagttttgagacatcttccaatgactgaataatatctaaatctttcatttttcctactgccgctccaaatccagtcaaaacctgtgatgttgaaaatatcttacttactttttttccaaatggagattcacttattccatactcaatcaattcctcctcatcaacaatatggttatctgtaatttttctcaacataccaaataatttcatatatgtttcaagaaattccttaaataaatcttttgaaacatcttcttctgacatattctcgagcattttaatattttctagtatatcttgtcgatcaattggtaattcgtttcgattcatataagaattaaatccttcaattgcatttttaaaaatgaactcattttcgtctggatccgcttttccttctttgtctgttaccagttttactccctcaaattcagtatttaacatatcactataaagcatttccaactgatgtcttgcagacatgggagtttgtcccgtatttaaagtcaacattctgtataaaattccgaacttatttatttctacataaatttctaatctcaacttatttttcaagaatttttggtactcttcgtctggtttctttttcatatcagtatctgcatcaattaatgtataggtacgttgtaagccatctaaaagtaaaacattttcactatgttcatttatatattgcaacattttttcttgatccggattctcaatatcaattatatctgtttttacaagtgctaaaactaaaggcggcataatacaccctttttgtaaatcgttctttaacagagaataaatcgttttcgaagtttttactctttttctttgcaactcattattattaataattttttttgcaaacttcaaatactctccaaatgtactttcaacatagaaattccaactattgattcttttatcaaatacttttgacattatcagcattaccattcctcttttctttagatatactcaaataattcaatatttattcatatagaactattcttgattaaaaatcttctctaagtttttctccatatccgccaccaaattaaccaccaatgcatttcccatcataaatctacgttttctcaacggcatttccaccgtttttcccttaactaaacaatattttgtatgattagtaggaaagccttgaatacgttctgcctctgtcgctgtaagtagtctcactcttccagtcattttatcttttacaatatgggtagttctactaaatccaccttctgatgtaagcatcgtacgtgctggcttatcttcctgatcaatcatagaaattgctccttcagaaaaaatatattcgtgaccggttgcacttgttcgcaataatttttttgctcctttcaaatactgccatgtctgtctatcttcttttggaagacgctgttcagtttcatcactatgtgtaactgacggatttgtataatataatttttcttctggtataaaatactcctcctcaacttctcctgtttccataacatctcccaaagttatctgctttccattataagtaggcgttgtctttatcgtatatattattccgtccttcattataccagaattttcgaatgcacattgaaatgtatcagatacttcccctatttctgttggtagcactttaaccttcatcttcgctttatctgctttatttactgcaaatgtttctgcaaaaaatccctcttttaaaactacattttccatacattctatttttttatcctcttccaattcatcagtatatctaattgtcttcaaaattctctctgcatattttgtatcgtttttataagcaaaaataaatatccgacgacgtctctgctggtatccatattctgctgcattaataactcgccattctaccgtataaccttcatctctaaaacaggctaacataacaccaaagtctttacctctttgcttggccggagattttaataatctatcgacattttctaataacacaaatgagggattctttacttctaatgtctcgcgaatcgaccaccatagaacacctttttttccttcaagtccctttgacgtagctaacgaagaagctactgaataatcctgacatggaaaacctccaactaacagattaaagtcaggaatctttgctttatctacatcttcaatattataatttgttgtatcctcaccattaatatccaatcggggcccaaatcgatatacataacagtcatgtgcgtattgtgtagttttttctgatggctcccattgattaaaccaaaccgtatcccatttttcctctttaccataatcttcggctgtttttatattattaagtccacatctaaaaccgcccactccggcaaacaattcgcaaactgttttcttcactttttttacctcttcttttttattattgaacgatcgttcttaaatataataaccgatttttacattcttgtaaagatccttttctattttttaatatgattttataaaatctttaatctgttgttttatatatttcttattaaaccaaaagcactgttttgtcatatactctcctgtaggtaccggaacatctttcaattcctctggaatttctttaagtacgataatcttagcaggcttttttaatttcactgaattactgttttcacaaaaatattcgctttctctagctttatttcttacatgtgccactttattaaaattactctttggaaagttattttcatatgcaaatatcgctcttccctttctatcatgagatattttctgttgtaatcttattccattttttatcacattccgggtctcttcccaaacttcttttactttattttcatcttttttaggaatataccacatcattgcattatttaaaatttcttttccctctgaatttttagaaaatatcacaagtaaaaactttgaatcaatcatttcatcataaacaatagactctttccatgttttttcttttaataattcctcaaaatcaaatgttgaaaaagacatatcttctaacggcattccatttttattaactgttatcgttcttaatttataattggctttttgaaactcatccgttttctctaagtcacaatcactcttatatatttgttttataatgccatgcttgtgactatacccgtcacgataatctggaaactccttttttaaggacttaactgttcttcctaaatatttttgtaatgtttctaataaaatatcatcaaattccttttcttttgataaaacaatatctggtaaaacatatgattcttcatcctcgtccaacattctttcattaaataattttgtcatatatgactttttaaaagaatatgcccttggctttgcctttggatatctatcatcatattttaccttcttatttcctccgctaccttttgtggcaggacttaggtacataaaatctcgttctgttaattcatgtgctcttccttcttttacatacctagcaatcttttcccagtcatgctgtataatcgacttatccctttctggcagttcatttagaagaatttcatctatcttttgaacactaaaattctcacggtctatccctttgatatattgataatacatgattaacaaatgatgatttttaatccaaaatctactttcttcatattcattccagttttcatctttgtaattaatttttccaagtgataatctttcttttgctctatatcctctactatttttcaaaaaaggggttactttcaattcaatatctgcctctttaaagtctggttcggcatctttattgcacgcataattaaaccacccttcttcgtatgcctgtcctatatctcctttcccatgcttctcttttaaaccatttttctcttgaaatttcttagctaattcaaaaatttctttaaagggacgtcctattgcctcttctgctctttttttcacttcttctgaatttttgtactctttattatccattttatcaatctccaataaatttcttatctaattgcgacaaaatataactattattcaaccaaaaacactgtttcggatactttcttccatctggaagctcataagtatcttttgaatttcgtgcatgaggtcttacatgacacactggattttctgataatttcggaaaattattataattctttccatttttcttttctatctgaagaccttcacgaattactctttgtgtcttttcccaaaccaacctcacatttccttccaaatcatcatatggaatattccagaactgacaccctttcaatctcagctccctgccctgatcatacttatatataacaaataaaaatcttgtttctcgcaaataatttccaaatgtagagtcattccattcttcctctactaattctttaaatttgaaagttgggaaggacatgttttcctttattttattatttttctcaatacgtattgcctttactaccacatttgctttttcaaattcctctgcatggtttcctttaatccctaacatacgatatgccaacattgcttccaggcttttcggttttttctgatattctatatgaaactcattacataagtccataacggtccaatcataatatgcatctatttttcgcacaacataatcttcaaacgattcttctgcatctccctttataattggttcatatgtattcttccctggaataatatagttattgagaacatacgtcatatatgaatttttaaatgcaaatgcgcgcggttttgccaactcgtcactaaatggttgttttcttctatccttagaagttgctgccttaggagctgctcctaaataaagagtatctccctcagataattcatgtgcctttccagctttgattttttcaacaatagactcaaaatcatgttttataatttttatatcttgttctgttggtgtaaataacttcacatatcctatacgataatctaatctatcctctatttctttctgatataggtaataaatcaataaaatcaaactggatttttgccacatgtggctatcttcaaacttttcattaacaaccgaaaaataatcaatcattgtcaatatcagtctctcttttgcgacaaattttccatttgtattttgtttatatggtgttaccttaagttccacacctgccttatcaaaatctggtcttgcatcgttattcgtctgataatgaaaaaatcgttcctctatcagttcacccaaaccaccttttctttttttatttgcatgctttacttcataatttgaagcttctctaacaactgttgattttgtaatatcatcttctctacatacatctgcaaaagtttttcctatcagtttttttgcatatgtctcgattgaaataggatctgtttcatcatattctttcaagtaacttcccatttatattccccctcatcatctatttcttccaatttctgatcaaatattgtttcttcaattacttttatacattgctctgtattttttaaaatatcttttccccaaaagtgtatcactgtccaacccatagagcttaattgtttgtccttttcttcatctctctgaatattccgttctatttttctaacccaataatctggattttttcccttttccaatttagtttttagtactttccagtctttaccatgaaagaactcactatcacaaaaaatggcaatatgatatttagtcaagacaatgtctggccttcctggcaattccttataattttttctataacgaaaacctctactccacaacgcctttcttagaacaatttctatccttgtatcttttccatgtatcctactcatatttttatgacttttttctgtaacttcaccatgaaaacgcggttcttttgctggcataatttttcaccttcaatattatatattccactttattgtatcaaactaataattactattcaattgctacactaaagaaaaaaggcacgttttttatcaacgtaccttcttctcaataatatttaatttttgattacaaataaattagtttttgtaaaactatttcttccacgctagcttttataccattcatcctcctcacccattccatccaattctcttctctcatttcttctgccactccatacctttctgccatctgcttcaccagtatttctacctgttctcctgcctccttatcaatctgtttcagatactctgtcagctttccgattaatataagatattggtaataccctgatttatgttctttcagataattctttctcagtattccatactttccataagttgcttcttcctctttaataattagttccggaaaataataatctccctgtaaggtatagttcagcccattcgttttatcatgaattcgttttttcatagttctaaatctccattcccctgcatctcgttctactacttcgttgatgttgattttccatcatgctttttcttttttcctgttttagtaattctaaaatacttttccctgatgactgctcctttctgtttttttcttcgatttccatttctctctgaatgtctttctgtatggcttccttgacagttttatttccaagaacccgtactccctgctatattgttctgaaatatccagcaactcttctttttcctcttgtaagtattgatttctctgttgggctttgcttaagtcttttttcacggcttcgcagatttgtttttctctcttatatttttccttccatttttctatttcggtgttaagttcctgtacttgtgctgccagtccggcaataatgcctttcatctgattgaacagtggtgttattttcttatcccggtaagtggaggctctttctaaggctccggcctccggcagttctggaataagctttctgcattcttttaattctttgctgactttatctattattggctgcaattgtgcccgttgctctgccagattctctaattctttctgtgtttcttccgcatatttttctgccaattctttctcctgaatggcctgttctttatcttctctgagatttttaatatccgctctggcatcggcaatctgcaaagtcagtccttcgttttctgctgtcagatattctttctcctgctctaattcctgtacctcttttttacgctcttttttcttaaaattatatacatcgagatgttcttcctgtgtgcctttttgtttccattcgattccatgctgttttgctatctcggcaaggatttctttttcatgattaatccattgattaagctccgtagcatgttttgttcctccctggaatccctgactttttaatgcctgcttcagtgaaactcttgtatccattccttttcccttccagcctgtcacataaggaacaaaatctatgtgcagatgtggtgttgcttcatcctgatgcagatagcagctaaataccctgagattggaatttcgttgctgaaaatcctgcatatactgatctaacacttttactgcgagattcccttccggggttccgacagccatatcttcacagtttccaatctgaaaaatcacttcatgaaataacttttcctgtttcccctgacgtattttttcataataatttgtaatctgcctgtcttttctttttccaacattataacgctctactgcttcatcaaatagctgacggtaaacaccttttatgttttcatcacaatagcagatgtttaaatctactctgtcctgatctacattttccgctataaaatcccgtctgttatgtgccagtgaaccagctccaaccattccgctgattgttctttttattgccatccattctcacttcctttcgtaaaaactcatatcggatataatacagttctgtatctttaatgtattctaaaatctaaaaacttttcctgttggctacggcagttttgttacttttgtcaaaagtaacgcaaaagcactttcgacagccgtaccgtccatcaaaagtgcctttgcgccctgccgggggcaagacgtcctgctgacgttcgttcttcatcagataaacgggcatatacctgtctcttctgttagctgattcatgtctgtattatttcttcaccggttttattcttctattctcacacgaatatactccagatttccgctgtacggagtttctaccagataccactctcttttcggattcatttccattctgctgagaatccattttccatccataaatacttccattcttttcccacagtgaaatcctgtgtgtacccataaatcagaggataatagaccatatctgtcatttacacgattgtaagctaaaattccttctttcattatcatctgctcccttccgtctataccagctaatataatcgcattttgtaattctttgatagactttgtatactgtagcctgttagcctgccagtaacctgtgactgtatatctgctgattttctctttgaatgttctgtacaggtgcgtgtcacgctcctgttataaggtaatcagggaaagtatttaccatcgaaagtcttctggtattcctcttctatccagatattcctgacgatatttttccctttcttcctccgtaggtgcagttttgtatctgctgtatatttctctttctgccatggcattcatcttcttttccagaccctgtctgattttttcttcgttctgtctgtactccatcagatgatactgtaaaagcagtaaaaatagttcataaggtatctgcacattcttatttttcattctgactcctttcaagatggcaaggtaccctcttcttaagaaatggtcatcttgccatcttcttttcttactctgacaatatccagaaccattgatttccacgtttgaccgcatcaatcccaagttcctgctttgcatttctcaatgtttttgactttattccacacttttctgcttcttcttcaatctttttctgtgccatgcctccatcagataatattttcttcagaaactcttttgcctgccggcttttctgtcctctggagtctccacagagcagttcatctgcactgatgtcatattctccaatccactcaaaaccattatgctggtctaaccgaaaagcaatcgacttaccttctggcgcaagagagcttttcacatgacatacaactcttgtttccggttcttcttttattcgtccaacaattaaaacactccttgctgccgcctgaaaatctatggaaccaagtccacgataagaagattttccattactgtttttgttcatgtgcccaatcagaataattgcacactgatatttttctgccagaacagctaccctcttcataaccggacgtatttcatttgctctgtgcatatctacatctgatccaagaaatccctgtatcggatcaagtacgaccagtcttgccttggtctggataatcgcttcttccaatcgaatgtctaacatagtcaacggctgttcccgatcgtcaattaccaatacctttgagcagtctgctcctgctgccagtaaccgtggttttatcgtatcgcccagcccatcttctgctgtctgataaattacatttactggctgttgtaagcactgcttgtttttagatacatccatatctgctttattttcatcggtgattacatctgctctttctggttctttccgcttttcaaatgaagcaggaagaattggttcccctctggtcagcttcgcaataatctgtaataccatcgttgtttttccctctcccgggtctccctgtataattgtaactttcccataaggaatgaatggatagagtagccatttaatctcttctacttccactgattccatatttatcagtttaagtggaggctcctgcctcacaatttcttccagtctcataattctgtctccttttgctaagaggcagattctccgtaaacagctaatttcaaattgttatgaattttaatctgtgatatacttaatttgcgagattggtatatctgcttagctgattaccgaagaatctgcctagattttttatctgggctttttcttttttccaacatcattcattttcattatctcctgctgatcagtccttacctttatttttttcatccaataatgcagccacctctttttgtcgtgatggataaagatgtccatatgtattcaatgtaatctgaatatttttatgtcccagtcgttctttaataatcaatggctccacaccctgattaatcagataggccacatgactgtgtcttaaatcatgtactcttattggctttactcctgtctttttttcatatcttttcatccgtttctgaagcgtccttgccactattggaaacagacgctcattttctggaaatccataatgataactgatatattcctgaacttcttctttaagaaaatttggaataataattgttctgacggaattatctgttttaggcgtactgattacatcttttccatctattctgtgataggttttattgatatgaagtaaattattggtcatatcaaaatctgcaattgtcaaagaaagaagttctccttcccgaattcctgtccagaaaagtatttcaaacataagatagtcttcactttttctgtccacacccgaaataaatctgtcatactcctctttaatccagaaatccagcttatccgcatcagactttcccatacgctttactttcttacagggattttctttaaggttgtaaatcctctgtgcatgattaaatagtgcattaatctgattctgaatcattctctcatatgttttgctgaacttattctcctgtataattttctgccactgaataatatctgcaggagtaatttcatttaattttttatttccaaaataagggatgatatgtttgttaatcatgtgctgcttgttccgtatggaatttgcctttaattcattcttcttatctgaaaaataaatatctacaaacttatccatctgcatatctggttccacagccactgaatttttaaattcattttcataattcagtgcttctctctttgttttgaaccctcttttcatcttctgtcttttctttcctgtccagtcaatgtatcggaaagatgtgtaccaggttccatgtgctttgtctttataaactgacatctgctcactctcctttacattgatttctgagaaaatccataaaattttgtttcccaatagggacgtggaatctttccacgaactgctacatatccttctttttccagctcattatttagctgttttaaaatagaatatgctttgctacgtttcactcccagttcattcatgacatcttctactgtcatcatataatttgttctcatatagccctcctttccagtcacttttgtgactctttatgtttcttatattaattgccttttgtgaatttgtcaagtatcttttgcgaattatattttgttttattcgcactgtttttactgacataaatctgtatcttttgtttcattcacttttgtgttaaactataagcacaattaacgtattcaattttacaaatatataaatattttaaggagatcgctatatggtaggaaaaaaaatccgagcttaccgggaatttcgtggattcagtcagattcaattagcagaactgtctggaatcaatgttggaactataagaaaatatgaattgggaatccggaatcccaaaccagaacaattagaaaaaatagctgctgcacttggcttaaatgtcagcatttttcttgattttaatattgaaacagttggcgatgtactatccctgctgtttgccatagatgactctgtaaatttatcactttctgaaacaaggaatcagaaaattattttagacttcgataatccaatgatgcaggatttctttaagaaatggtgccaatttaaaaatgtttatgagaaagaaaaggctgagatattagctattgaagatgaagataagagacaggaagaactgtataaactgaacgctactcaggaagagtggaagttgagggcaatgggaaccacgatcgggtgtcatactgtgattaaaaaaggaacggaagataatgtcattaaaacttatgatctaacatgattttatataaaaaaagagctcttacgaactctgaattttgggaggtctgggatgtttgtatatttttataaatcgtgctaccattacaccacaccatcacatacacccagaccaaataataacgaacattgtactctcatagaatcaattcctttcttacagacatatttaatcatatcatacactaatccagaaactaaacactctgataatacttctactaattttatggtgtttggaatcgaaccaaatcctattaatatcttaattatgggtataagtatattcagtaatttctattttgtcaactaatttctcaatttttgttatcaagctgttatcataaagtaactgtcataaaaacttccgttcattttcttttgctatgcgtttattaattctaagttatatttattcgtatataacatatctcctaacttttccacacaacagaaaaaccccagaaacattagtttctggggtgaatcttacgcttgaacacaagtaccttgcggtacgatatatataaaatctagtattattcagttactaattatataagttcgtgattactcgaggatagaagcaacacgtcctgatcctacagtacgtccaccttcacggatagcgaatgtaagaccctgctccatagctactggatggatcatgtcgattgtcatttctacgttatcaccaggcatgcacatctctgttccttctggaagagtgataacacctgttacgtcagttgtacggaagtagaactgaggtctgtagttgttgaagaaaggagtatgacgtccaccttcatcttttgttaaaacgtaaacctgagctgtgaacttatgatggcatgttacgctacctggctgagctaatacctgtccacgctgaatttcgtctctctgaacaccacgaagaagagctccgatgttgtcaccagcctgagcttcgtcaagtaatttacggaacatttcaacaccagttacaacaactttacgtgtttcgtctgtgataccaacgatttctacttcatcagatacgtgtaatacaccacgctctactctaccagttgcaacagtaccacgacctgtgatagagaagatgtcctcgataggcattaagaaaggcttatctgtgtcacgttctgggttaggaatccatgtatcaacagcgtccatgagttccatgatcttgtctccccatggtccgttaggatcttcaagagccataagagctgaaccctggatgattggagtgtcatctcctgggaagtcgtactcgtttaataattcacggatttccatgtctactaactcaagtaactcttcatcgtctaccatatcacatttgttcatgaatactacgatgtaaggtacacctacctgacgggataataagatgtgctctttagtctgagccataacaccatcagtagcagctactacaaggatagctccatccatctgagcagcaccagtgatcatgttctttacataatcggcatgacctggacagtcaacgtgtgcgtaatgtctcttctctgtttcgtactcaacgtgagctgtagagattgtgataccacgttctctttcttctggagctttatcgatgttttcgaaatctactttttcgtttccttctactctttcagctaatacttttgtgatagcagctgttaaagttgttttaccatggtcaacgtgtccgatggtaccaatattacaatgtggtttagttctctcaaacttagctttagccatttgaatttcctccttaaaattacgcctgataggctgtctttataattttaaatattctcgtccggcaaagaatcgaccagacgattccaaatcacagccagactgcgactataaagccgcacctgctgtaattatatttcattttaacattatttgcaagtaaaactttacagataatctttatctatgaaattatttgttctgagctgctaaatgagcatccagaatcttttcctgtacgttcttaggaactttttcatagtgatcaaagaacatggagtagttaccacgtccctgagttcttgaacgtaagtctgtagaatatccgaacatttcagataatggtacaaaaccatgaacgatacgtccgccacctacatcttccataccttcgatacgtccacgacgagaattgatatcaccgataacatcacccatgtactcttcaggcattgttacgtcaaccttcatgataggctcaagtaatgcaggatctgctttcttcatagcatccttgaatgctaaggaaccagctaccttgaatgccatttcagaagaatcgacttcatggtaagatccgtcgtatactgtagcgtgtacaccaacaacagggaatccaccaaggataccagcttttgctgcttcttcgataccagcaccaactgcagggatgtattctttaggaatagcaccaccaacaacttcggaatcgaatttgaatgtttcttctccgttaacgtccataggctcgaaacgaactttacagtgtccgtactgaccacgtccaccggactgtttagcatacttagaatcgatatcaactgcttttgtgaaggattctttgtatgctacctgtggagcaccaacgttagcttctactttgaactcacgaaggagacggtcaacgatgatctcaaggtgaagctcacccataccagcgatgattgtctgtcctgtttcctgatctgtatgagcgcggaaagtaggatcttcttctgcaagttttgcaagagcttctgccatcttgccctgtccagcttttgtcttaggctcgatagcgagctcgataactggatctgggaattccatagactcaagaattactggatgctgttcatcacagattgtatcaccagtagtagtgaacttaaatccaactgctgctgcgatatctcctgagtatactttatctaattcctgacgcttgttggcatgcatctgaaggatacgtccaacacgctcttttttgccttttgtagcatttaaaatgtaagaaccagagttcattgttccggcatatacacggaagaaagcaagctttccaacgaatgggtctgtcataatcttgaatgctaaagctgcaaatggagcatcgtcagatgcaggaacttctacttcattaccttctaagtcctgacctttgatagcttctacatctgtaggagctggcagatattcgataatagcgtcaagaagtttctgtacacctttgtttctgtaagctgtaccacagcaaacaggaaccattgtacagttacatgttccttcacggagaactctctttaactcttcaacgcttggctcttctccatcaaggtaagccatcattaaatcatcatctgcttcacagattttttcaaccatatctgtgtgatataattcagcatcatccttcatatcttctggaatatcaataatgtcaatgtcttcacccttctcatcgttgtagatgtaggctttcatttccattaagtcgataattcccttgaagtcatcttccttaccgataggaagctgaataggaatcgcgtttttacctaatcttgttttgatctgatctactgcaccgtagaaatcagcacccatgatatccatcttattgatgaatgccatacgtggtacattataggtgtctgcctgacgccatacattttcggactgtggttcaacaccgccctttgcacagaagacaccaacagcgctgtccaatacacgaagagatctttctacctctactgtaaagtcaacgtgtcctggggtatcaataatattgatacgatgctctaaagcaccttttttaggtttacaatcctcttccagagtccagtgacatgttgtggcagcggaagtgattgtgatacctctttcctgctcctgttccatccagtccatggtagcagtaccttcatgagtatcaccaatcttgtaatttacaccagtgtaataaaggatacgctctgtcaatgttgtcttaccagcatcaatgtgggccataataccaatatttctggttctctcaagtggatattctcttccagccaaggttttttcctcctataaaatgtatccggacggctgcataatctatgcagcacatcctgtgtaaataacttattagaatctgtaatgtgcgaaagctttgtttgcttctgccattttgtgcatatcttcttttttctttacagatgcaccagtgttgttcgctgcatccataagttcttttgcaagacgctcttccatagtcttttcacttctcttacgagagtaaagagtaatccaacgaagagctaatgcctgacgtctgtctggtcttacgtcgataggtacctgataagtagcaccaccgatacgtctagccttaacttccagagctggcataatgttgttcatagcctctgtaaatacttctaaggcatcttttcctgtttcttccgcaatgcggtcgaaagcaccgtaaacgattttctgtgcaacacctttcttaccgtctaacatgatgttattgataagctttgttaccactttgttattgtaaataggatctggtaatacatccctttttgcgatatgtcctttacgtggcacggttcttccctccttaattaaatgtgattttcatttcttcatttccatgaggaaatgaaatattaaatcatcggtactcatggaaacttctgtttccgttgttcatgctcggacaagtcaatatattgcctgcaaccaacagagaaaatattgctattccggcattctcactgatatttatttcttaggtttcttagcaccgtatttggaacgagcctggcgtctgtttgctacgcctgctgtatcaagagtaccacgtacgatatgatatcttgtacctggtaaatcctttactcttcctccacggataagaacaacactatgttcctgaaggttatgtccttcacctgggatatagcttgttacttcaataccgttggaaagacgtactctggcaatcttacgaagcgctgagttaggcttcttaggagttgctgtcttaacggctgtacatactccacgtttctgtggtgagctggcatctgttggtcttttctttaaggagttaaatcctttctgaagagcaggtgccgtggatttctttgctacagactgtcttccttttctaactaactggttaaaagtaggcattctgaaattcacctccatgcatattttctaatgtggttgctaatagtttcttctttaggttaaaccaatatgacaaatcatcttgattatacccatatgtggacatagttatacatcgcacacaattaaagattatatatttaaaaaatctttttgtcaaggggaaaattgaatttcatttttctcgaagtgccagaaacagacgaacccagaagaaaccaactccagccacagtcaggcccctgagaataaaataatccctatctgtgacctgggagcaaggtttgaacgttcgcgcgtctaagcgaacattcaaaccgcagcgacgaaagtcacagatagggattattttattctcaggggtcgtctgtcctgtatcttaattaaagattttcagaatccatcatcattgctgcatcctctgacttctgatcacgtatttcttcttccatagaagctgcatcatagtcaaattcgtctgcttcttcgatcttgttgacaacttttcctgtatcaagatgaaggttacgatacttctttaatcctgttccggctggaatcagttttcctaaaagtacgttttccttaagaccaattaatggatcaatctttcctttgattgctgcatctgtaagaacctttgttgtttcctggaaggaagcagcagataagaaagaacttgttgcaagagaagcctttgtgataccgagaagtgtctgctctgctgttgcaggctcttttccttctgcaagaagtctttcattctcatcctctaattcaaggatatcaatgagtgctcctggtaagtaccggctatctccagcttcttcaatacgaactttcttaagcatctggcgaacgataatctcgatatgtttatcgttgatatctacaccctgcagacggtatacacgctgtacttcacgcatcatgtaatcctgaactgctcctgcacctttgattcttaagatgtcatgaggatttacagaaccttctgtcagttcatcaccggcctctaagtaagtaccgtcaagaactttgatacgggaaccgtaaggaattacataatttcttgtttctccgctatcctcatttactacagtgatttcacgtttttcttttgtttcttttacatccgcacgaccagcaatttcagtgatgatggcaaggcccttaggtttacgtgcctcgaaaagctcctcgacacgaggaagaccctgtgtaatatcatcaccggctacaccaccggcatggaatgtacgcatagtaagctgtgtaccaggctcaccaatggactgagcagcaataattccgactgcctcaccaacctgtactgcctgaccagttgcaaggttggcaccgtaacatttagaacatgcaccgttatgggacttacatgttaacattgttctgatcttaacctgctgatatcctgcgtttacaattgctttcgcacgctttggagtaatcatgcagttcgcttcaacaatgatattaccttctttatctttgtaatcttctgctgcataacgtccgctgatacgatcctctaatgattcgattgtttcttttccatccatgatagcttctacatacatgcttggaatcttgtttgttccttcgcagcaatcctgttcacgaataatcagttcctgagatacatctacaagacgtcttgtcagataaccggaatcggctgtacgaagggctgtatcggaaagtccctttctggcaccatgtgcagaaatgaagtactccagtacgtcaagaccttcacggaagttggacttgataggaagttcgatagtacgtccggatgtatcggccatcagtccacgcataccggcaagctgtttaatctgctggttagaaccacgggcaccggagtcagccatcatgaagatgttgttgtacttatcaagaccactgatcagtttatctgtaagttcgttatcggcagcaaaccatgtctgtactactgctttataacgttcttcttctgtcatgaaaccacggcggtattgttttgtaatgtactcaacctgtttctgagctgctgcaaggatttctggtttttcttttggtacagtcatatcggaaatagatacacttaacgcaccaattgtagaatacttatatccaagagctttgatattatcaagaacctcggcagtcttagttgtaccatgtacgctgatacaacggtcaaggatctgttttaactgtttcttaccacactgaaaatcaacttctaactttaagaagttatctggatcagaacggtcaacaaaacctaaatcctgaaggatgatttcgttgaaaagaagacgtcccattgtacaatctataatacggcttcccattgttccgtctggtctcatacctcttctctttactttgattctggaatgaagtgtgattaccttgttctcgtaagcaagatatgcttcattttcagacttaaagcatttaccttcacccttagctccttctttttccatagtcaggtagtaaataccaaggaccatatcctgagaaggaacggctactggagcaccatcagatggcttcagtaagttgtttggagaaagtaagaggaaacggcactcagcctgtgcttcctgggaaagtggcagatggacagccatctggtcaccatcaaagtcggcattaaacgctgtacatactaatggatgtaacttaatcgctttaccttctactaatgttggctcgaatgcctgaataccaagacgatgcaaggtaggagcacggtttaacataaccggatgttctttgataacatcttcgagtacatcccaaacttctggctgtaacttttctaccatcttcttggcagacttaatattatgagcaagaccgtttgctacaagttctttcataacaaatggtttgaaaagctcgatagccatctcttttggaagaccacactgataaatctttaattctggtcctactacgattacggaacgtcctgagtagtcaacacgcttaccaagaaggttctgacggaaacgtccctgtttaccctttaacatatcggaaagggattttaatgctctgtttccaggaccagttactggacgtccacgacggccattatcgattaacgcatcaacagcttcctgaagcatacgcttttcgttacggataataatgtctggcgcaccaagctctaacagtctcttaagacggttattacggttgatgattcttctatataaatcatttaaatcggaggttgcaaaacgtccaccatctaactgaaccattggacggatatccggagggataaccggaacagcgtcaagaaccatccattctggacggtttcctgacagacggaaagcttctacaacttctaatcgtttaatatttcttgctttcttctgaccgctggcattcttaagactcttcttaagttcttctgcttcagcctctaagtcgatctctgcaagaagttctttgattgcctcagcacccattcctacacggaagtttccaagaccttcatcagaattcctatattcttctgttacacgacggtactcagcatcagagataacgtccttcttgcttaagtttgttgttcctgggtcaagaactacaaaggaagcaaagtataatactttttccagtgcttttggagacatatcaaggattaatcccatacggctagggattcccttgaagtaccagatatgggatactggagctgcgagttcgatgtgtcccattctttctcttcttacacttgcctttgtaacttcaacaccacatttatcacagacaacgcctttatagcgaatctttttatatttaccacagtgacattcccagtccttgcttggtccgaaaattctttcacagaacagaccatctttttccggctttaaagtacggtagttaatggtttccggcttttttacctcaccatgagaccactgacgaatcagttccggagacgcaagtccgattttaatggcgtcaaaattaaccggctgttcaactgtttggttattcatatcagacataggttactccttccaaactatcttacaaatcagaatcgccaaaaggcatttctgtaaactctggctgtgcatcagcctgtccagcttcttcttccagagtactttctttgtagccatactctccaagattgctctcgtccttataattgttatcatccggactgctctcaatcactgaagtaagggattcattaattgtttcgctgccttcctgaagctcaatttctgtcatatcttcttttaagacacgaacatcaagagcgagggactggaattccttaagaagtaccttgaaggattccggaatacctggttcaggaatattctctcctttgatgattgcttcgtatgtcttcacacgaccaactacatcatcagacttcacagttaagatttcctgaagagtgtaggaagcaccataagcctcaagagcccaaacctccatctctccgaaacgctgtccaccgaactgagctttaccacccagaggctgctgtgttactaatgagtaaggacctgtagaacgtgcatgaatcttatcatctactaagtgatgcagcttcagataatgcatgaatccgatggaaactggtgaatcgaattcctgtcctgtacgtccatcacgaagctgaaccttacctgtacggtcgattggaacacccttccattcttctctgtggtcacggttatcccaaagatacttcataatatcatcgttaaccttgtcaccccagcgttcttcgaattcttcccatgtcttgttcgcatagtcattcgccatctcaagagtatccatgatatcgttctcatctgcaccgttaaatactggtgttgctacattaaatccaagcaccttagatgcgagacttaaatgaagctctaagacctgtccgatattcattcgggaaggtacacctaatgggttcagtacgatatcgagtggacggccattaggaaggaatggcatatcctctactggaagtacacgggaaactacacccttgttaccatgacggccagccatcttatcaccaacagaaatcttacgtttctgtgcaatgtaaacacgaacagacttgttaactgttggaggcagctcgtcaccattctcccttgtaaatacctttgtatccataacaacaccgtaagcgccgtgtggaacacgaagggaagtatcacgaacttctcttgccttttcaccgaaaatagcacgaagaagtctttcttcagcagtaagttctgtctctcccttaggagtcaccttacctaccagaatatctccggcatgaacttctgcaccgatacggatgataccattctcatccagatcttttaatacatcttcactaagaccagcaagatctcttgtaatctcttcctgtccaagctttgtatctcttgcctctgcttcatattcttcaatatgaacagatgtatatacgtcattctgtacaagacgctcacttaaaagtacggcatcctcatagttataaccttcccaggtcataaatccgattaatgggttcttaccaagagccatctcgccgccgcatgtggaagcaccatctgcaagaatatctcctgcttcaacatggtcacccttatttacgataggtctctggttcatacagttaccctggttgcttcgggagaacttaattacgtggtaagtatcacggattccgtcttctcgttttacgataatctctttacttgttgagtactcaactgtacctgcatgatgtgcgataatacatacacctgagtcgcgggcagccttagcttccataccagtaccaacaactggaacttctgtctttaacagtggtacagcctgacgctgcatgttggatcccatcagagcacggttcgcatcatcgttctcaaggaaaggaatcatagatgtagctacggagaataccatcttaggagatacgtccattaagtcaattcttgactttctaaattcagatgtttcctctctgtaacgaccggaaacattagtgtgaatgaagtgaccttcttcatctaatggttcgttcgcctgcgctactgtgtagttatcttcttcatcagcagtaaggtatacaacatcatctgttacaactgggttctgtgggtcactcttatctaccttacggtatggagcctcaacaaaaccatattcattaattcttgcgtaagttgcaagagagttaatcagaccgatgttaggaccctcgggagtctctacaggacacattcttccgtagtgggaatagtgtacatctcgaacctcgaatccggcacgatctctggaaagacctccaggacctaatgcggaaagacgtctcttatgagtaagctcagataatgggttatgctgatccatgaactgagataactgagaacttccaaagaattccttaacagcagcagtaactggtttaatgttaattaatgtctgtggggaaatggactcaatgtcctgtgttgtcatacgttctctgacaactctctccagacgggataaaccaattctgtactgattctgtaacaactcaccaacggcacggatacgacggttacctaagtggtcgatatcatcatcgttaccaacaccatactcaagatggatattgtagttaatagaagctaaaatatcttctcttgtaatgtgctttggaatcagctcagtgatattcttgcgaatctgtgctttaatttcatctatatcatcatattcttctaagattttttcaagggctggatagtatactaattcagtaacgccaacttcctctgggtcaacatcaacaaagcttgtgatatctaccatcatactggaaaggacttttacttctttctcttctgtctcaacgtaaacataaggaactgctgcgttctgaatagcgtcagcctgttcttttgtaagtcttacacctgcttcaaaaaggatttctcctgtggaaggatcaagtacatcctgcgccagtctgtgtcctgcaatacgattgcggaacattaacttcttattaaatttataacgtcctacttttgcaaggtcataacgtcttgcatcgaagaacatactgttaatcaggctctctgcactgtcaactgataaaggttcacctgggcggatcttctcgtataacttcttaagaccttcctggtagtttgttgctgtatccttttcgagagtttttaaaatcttaggctcttctccgaataattccttaatttcagcattggttccaatgccaagagctctgataagtacagtaacaggaacctttcttgtacggtcaacacgaacatagaatacatcgttggagtctgtctcgtattccagccatgcaccacggttaggaattactgtacaagaatataacttcttaccaatcttgtcgtggctgatcgcatagtaaatacctggagaacgaactaactgactgacgataacacgttccgcaccattaattacgaaagtacctgtttccgtcatcaatggcaggtcgcccataaaaatgtcgtgttgtttaaaatcatctgtttccttattatggagacgaactttcacttttaaaggagctgcatatgttgcatcacgttctttacactcctcgattgaatactttctatcctctctgcaaagctgaaagtccacaaactccaggctgagctgtccactgtaatccgtgataggcgaaatgtcctcaaaaacctcttttaatccatctgtaaggaaccatttgtaggaatctttctggacttctataagattcggcatatcgagaacatctttttgtctggcatagctcattctgatgtttttgcttcccggaattcgcgttggacgcagtctattcttttccatcgatgttttcaccccttgaataatcataatgttaaatcttctggttactttccaataggcatacagacccattgtgaatcagtttattatcatagcacatctgtcaagccatgtcaactaatttttttctcttattcttgattttttccagttttttcacttgttaaacatgggagtaaaatttcttccatataatatgtataaaatagcggcgaaaaaagggagaaattcggcaacttttttgatttgacaaaatggataagtgattactatctgattcattagggggaaacaaacgaaaaaagaaatactgccatatcccatctgctctgtagtcgcatctgggatatggtagtatttctttttattttcgtctgttttctctcaaagaatcaaatagttatttaacaaattcctttacagaagcatatacgcccttaccgtctaagccatatttttcaataagcttaactgctgggccagattctccgtaaacatcgttcacaccaattctcttaactggtactggatatttctcggaaagtacttcacatactgctccgccaagtccaccgattacggaatgttcttctactgtaacaaccttacctgtctctttcgctgcttctacaagaagatctgaatcgataggtttgattgtgtggatattgattactttagcttcgatcccatcttcagcgagcatatctgctgcttctaatgcggagcttacgcaaagaccagttgctacgattgtaacatcttttccttctcttaatacaacacctttgccgatttcaaatttataatcatcattatcgttaattacaggtactgcaagacgtccaaatcttaagtatacaggtccgtctaattcataagcggcacgtactgctgcttttgcttctacatcatcagaagggttgatgattgtcatacctgggatagtacgcattaatgcgatatcttcgttacactgatgtgttgctccgtcttcaccaacggaaatacctgcatgagtagcaccgatttttacattaagatgtggatatccaacagagttacgaatctgctcaaatgcacgtcctgctgcgaacattgcaaatgtacttgcgaaaggaaccattcctgttgttgcgattccggctgcgattccaatcatatcgcattcagcgataccacagtcgatgtgacgttctgggaaaacttttttaaacattccagtcttagtagctgctgcaaggtcagcatctaaaactacaagattctcatgttcttttcctaattcaattaacgcatttccatagctttctctggtagcgattttctttacttctgacataatgcttcctccactttctttaagtcttccatagctacagcatactgttcatcattaggtgcagtaccatgccaggatgcctgattctccatgaaggaaacacctttaccttttacagtcttcataacgattgctactggcattccttttacttctcttgcttctttaaatgctgcatctaactggtcgaaatcgttaccatctgctacattaattacatggaagttaaatgcttcaaacttcttgtcgattgggtatggagaacatacatcttcaatcttaccatcaatctgtaatccgttgttatctacgattactactaagttgtcaagctttcttgctcctgcgaacattgcagcttcccaaacctgtccttcctgaatctcaccatctccaagaagtgtgtaaacacgataggatttatttcttaacttagcagaaagagccatacctactgcagcggagattccctgtccaagagaacctgatgacatatcaagtcctggagtgtgctgcatacatggatgtccctgaaggtgggaaccgatatgtcttaatgtaactaagtcttctactgggaaatatcccttgtgagctaatgttgcatataatccaggtgctgtgtgacctttggataatacgaaacggtctctgtccggatcctgaggattcttaggatctacattcatttcctcaaaatataaatatgtaaaaagatctgctgcggataaagaaccgcctggatgtccagcttttgctgcatgaacgcctgtgacaattccttttctcacttcatttgccatcttctgaagttctaatttgttcatggtttcctccttattgcccaatataatcccagaatctgctgtacttcactttgcaatgaagattctgaaatcacatctatatcctattcaccaaatactgcgatataatcttttttaaacttctcaattccagcatcagttaaaggatgtttggtcatctgttcaattactttatatggaactgttgcaatatcagctccggccaaagcacagtctgttacatgaattggattacggacactcgctgcgataatctctgtatccagacctgcgacagcaaaaatctctgcgatatcacgaataagatcaacacctcttacactgatatcatctagtctgcctaagaaaggagatacatatgttgctcccgctcttgcggcaagtaatgcctgatttgcagtaaagattaatgtaagattggtcttaattccttcctgggaaagaactttacaagcctttaatccttctacggtcataggaatctttacaaccatgtttggatggattgctgcgatttcacggccttccttaatcattccttctgcgtctgttgttgtcgcttttacttcaccactgatcgggccatctacgatagaagcgatttctttgatgacttcattaaaatctcttccctccttggcaatcagagatggatttgttgtaaccccgcaaataacccccatgtcattcgctttcttgatatcctctacattcgcagtatcaataaaaaacttcattatcttctcctccgtttttcactctaagaataaagtaggttaacacactgctattatacaaagacttctgcaatctgtcaattggttttgtgggagaattcccttgcttgtgggatttatttcgtttttggttggaggagacaaaaaccaggagctggatagttcaaatatatgactttcgtcgcggcgctttgaatgctcgctcccaaatctccctccttgatttggttttccagtgattttaactgcttcttacaaaagtaggttaggaacgtacttatcggaaccatccacagtcagaaaataaaaaagacttatcatcatatttgtggcctcggagcaaggtttggatacgagcgcataagcgagcattcaaaccgccgcgactaaagtcacaaatacgatgataagtggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaggcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccaaagcctttttcattttcgtctgttaattatctaataagccgcctatcaactgtctgtcaaatggttcatcaaccaccaaatcaactattccccacatgttgggcaatcgtctggtgcaaatttttctttatcgtactcgattccattcttatcgtagtagtcttttacagcagcctttacagcttcttctgctaatacggaacagtgaatcttgtgtgttggcagtccgtcaagggcctcaactacagctttattagataattctaaggcatcatcaatagatttacctttaatcatctctgttgccatagagctgctggcgattgcggaaccgcatccaaatgtattaaactttacatcttcaatgataccgtcttttactttgatgtacatcttcatgatgtcaccacattttgcattacctacttctccgataccgtctgcatcgtccattttccctaagtttcttgggttacggaaatgatccattactttttcactatataacatgtttcttttctcccttctcaagttcttcccaaactggtgaaatgtttcttaaataagaaacgatttccggaacttctttaatgatatattcaatctgttctggtgtattctcttcacataatgtaagacggagtgatccgtgtgcaacttcgtgaggaagtccgattgctaataatacatggctagggtcaagagaacctgatgtgcaggcacttcctgaagaagcctcgattcccttttcatcaagtaaaagtaaaagggattctccctcgattccttcgaaacagaagtttacgttacctggaagtctcttcttagcatcaccgttcagacgggaatgttcaacctgtgaaaggccttcaattaagcggtctctcatagcagaaatctttgccatgttctcatctaagtttgctacagcttcttttaatgctgctgccataccaacaatggcaggaatattctctgtaccagctcttcttcctctttcctgtgcgccaccttcaatcaagttaaacagtggaacaccctttctaacgtaaaggacaccgattccctttggtccgtggaacttatgtccggataaagataacatatcaatgttctgtgcgtgtacgttcactggaacatgtccaactgcctgtactgcatctgtgtggaatgttactttcttttctttacaaatctttgcaatctcatctattggctgtaatgtaccaatctcattgttcgcatacataatagtaactaatgctgtatcttcacgaattgccttctctacgtcagcaggatcaacaattccgtctgctccaacatcaagtaatgttacttcaaagccttctcgctctaacttcttaagagtatggagaacggcatgatgttcaatctttgtggaaatgaggtgtttcttacccttctttgctccaaaaagagcagcagaacgaatagcctggttgtctgcttcgcttccgccggaagtaaagtaaatctcattaaaatctgcacctaatgcttctgcaacatcttctcttgctttctgaagcacttctgcagcacgctgtccggtagaatgcaggctggatgggtttccaaatacctcattcatgcactttgtcatcgcatctatcgcaacaggactcatctttgtagttcccgcattatctgcataaatatacataaattcaccctcttctttctaaatcctatctagtgtataggaattatatcttgaaaatcctatcttgtcaataggattttattaaaaagataccgctattcttgttttttatcatgtacataatttccgaaaaaatacttcttaaaatactttctgtctctcttatattacttttatatccatacgccatcataatttttacataaaaaacaacctcataaaaatactggagaaccaggttaaacccgaccctccagcaaatcctcaagcgtcactgtctctaaataatcatcaataatcccatccagtttctgccacatcggaagagtaatacaatatcctgccttttcgcaggttactttcccaccctctaagcaattgacaggagccaatgttttttctgtcagctttaaaatagaaccgattgtgtactcagacggctttcgcgccagacgatatcctccttttttcccgcgtccacttataagcatattgcctttgtgaagcaggctcacgatcatctctaaatacttcatggatatattttgattctccgcaatttcttttaacggaattaattcttctctgtcattctgtgctaaatagatcattacacgaagtgcgtaacggcctttggacgaaaccatcataattcgccacctcctaattcctaataatatactaggaattaagaaatagcaagcactatttttaatgcaataaacttcataaagattttcagcaaatgtataaatgagctttatgcagacaactctggctttcttccataaatatttttcaatactttaaccagtacttttttctgtactgtcccatactctgacgtctcaggtataacatatgcgctcttttctccacaagctgacgaaatagaaaatgttgccaaattctgaagatttgatgcaaagttcgccatcataacatcagctaacttatcagaaactttctgaaccttccagcaattctttgctttcacaaaacgaattgtaactgtttttgtcttaaaacgattaaactttgtatctttctgcgatttgtcaataattccatttaccagctttataacctgcttttctgacatggaagataaattatcaagctttccatctgccatataataaaatgcattcatacagaaattaaatgtaaaatcctcgcaattcacatagcggaacttcactttcacatctgccttattgccctttttctttgtggaaatgatacgataactcatcttactggcgcatttagcaaaatactttttaccactcggaaccatgtaaaatgccgacacaagctgtccaccttctccccagtccttcacatagcggttcattcctttgtagtcaaattctttcatctctttgaaaaatgctttctcagaaactttcaggcttttgcctgctgcttccacattctgtgctggtgccagcacaataaaaagcatgataagagacataactaatgcatgaatttttttcataagcttctcctttttctctctttgggccgtaaaaatcagcctttattcaatgcaagattgtgacagaagtcctcacagtaaacaaaacaggtgtacgccaacttttattcaatatacgaagcctctccatatcaaacattgtctttgctgtttattataacatatgcctttcttcctgttaattacaatatatcatttgtaatataaatttaatcttttttatatttctataattatttatcctcttacagcaagaagactccgacctctaaggtgggagatgaattgcgtctgctacctacttgatagagcatcctaattatagtatagtatctttagtcggataataaaaaattgagataataacgcacgtttagtattcttactatactatcatcttgtgcttgtgttcaagtatcgcaggtgggttttcgaggaaaaggaagtggcatggtggcaaacagagcatataaattcagaatgtatcccaatgatgaacagaagattttgtttgctaagacttttggctgtgtgagaatggtatacaatcattggcttgatagaaagatcaggcagtacgaggagaacaagacaaacgtaatatataccatttgtgcaaaagaaatggctgcaatgaagaaaacagaagaatacagatttttaaaggaagcagatagtattgcattacaataatcgctcaggcatcttgatacggcatttcagaacttttttaaacagccgaaaacaggtttcccaaggtttaaatcaaaaaagcggaataaaaacagctattccacagtttgcatcaatgggaacataactatatctaatggatatttgaaattacctaagattggccaagtccgcttaaaacagcacaggattattccagaggaatacagcctcagatctgtaacagtaagtcagacatcaagtggaaaatactatgcaagtatcctttttgagtatgaagaccaagtacaggaaaaagagatgcaaaagtttttaggtttagatttttccatgcatgaattatatcgtgacagcaatggtaaggagcctgcctatccaaggtattacaggaatgcggagaaaaaattagcgagagaacaacgcaagctttccaaaatgcagaaaggttcaaacaatcgcaataagcagaggcttaaggtggcaaaacttcacgaaaaggtttccaatcaacgaaaagactttctgcataagcagtcaagacagataaccaatgcctatgattgcgtatgtatagaagatttggatatgaaagcgatgtcgcggtcactgaattttgggaaatctgtttcggataacggctggggaatgttcacaacatttttgagatacaaactggaggaacaggggaaaaagcttgtgagagtggatagattttttgcaagcagccagacctgttctgtttgtggttacaaaaatgcaaaaacgaaaaatcttgcgataagagagtgggattgtccgcagtgtggaacccatcatgacagagatgtaaatgcggcgataaatatcagaaatgaaggaatgcgtctggtaaatgcatgaccttagagaacaaatataaccgtgggacacacggggatagctcgcatatgcttagcacagtagtgctatcgaacgagaaccaaacttgccgaggatgggaagcccccacctctataggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaatcctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcccgttatcataaaactactcagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacactattttagcaatattttattatcaaggaacattttggcatatatttgacgccctgtgatactaaacttaccactttttcagtggcgtcctataggtgggggaggatgtcactgcgataaactactcctttttacagaatatacaggctcagtttttgtcataaaaaatatttaccagcatttgtacaaaaaatctatatagcaaactataaatgagtaaatttaaaatattgcacaactatgtccgcattataaaaacatactttacttgcttggtctgaatgtgtttagactacaaacaagaagcacctatttttgtgcatttttctgtatttgctcacttatagtagcaaaatcaacctggtaaataaaattcacaaatctaacagcatcaatgtgtaccctgtaaaacattaataataaataatacagaagggaaaagatattttatggaacaaacttatatgaaagaaaaaccaattctgccacttctgctttctatggcggcaccaatgattttatccatgctggtaaattcactttacaacattattgacagtattttcgttgccaagatcagcgaagatgccatgactgcactttctcttgtatttccaattcagaatgttgttaactccgttgccgtaggtttcggtatcggcatcaatgttatgattgctttctgtctcggagcagatcagcgagaacaggcagataaagctgcctcacagggaatgtttctctctattgtacatggaattattttaagtataaccggcatcctcattatgccttcattcttaaaactgtttacgaacaatcaggacaccctctctttaggattacgttattcaaatatcgttcttcttttctcaattattatccatgtggaaatcacttttgaaaaatactttcaggcgatggggatgatggttgtcagcatgctcagtatgctgtgtggttgcatcctgaatattatccttgacccagttctcatttttggaattggaccgtttccacgacttggaatcgaaggagccgctatcgcaaccggcatcggccagtgttctaccttacttatttacattttgttttatatatttaaaaagccacccgtaacaatacgtaaacacctgcttcgccctgaaaaaaatgtctgcatacgcctttacggtgttggaattcccggtgcattaaatatggcgcttccttctctgcttatttccgcattaaatggaatccttgcatcaatttccgaatctggtgttatcattcttggaatctattataaattgcagactttcttatatttatccgtcaacggaatgattcagggaatgcgtccgctcatgggttacaattacggtgcaaaagaatacagacgagtaaacaaaatctaccggcttgccctcacaattgctatcggcatcatgacagccggcaccttactttttatgtttacgccagaaacttttatgaaaatgtttaccactcaggaaacaactatcgccgccggtgcatccgcactccgcattatttcctgcggcttcatcgtttcttctgtctccgtcgtatcaagtggagctttagaagcactcggaaagggaaatgaatcacttgttgtctccctgcttcgttacctcgtaatcatcgtaccattagcgttcgtactcagccgatttatcggcgcaaatggagtatggcactctttctggataacagaaacagttacggcatttgtggcttatggcatttatcgaaaagccttgcgtaataagtagaaacagacgaactcagcatgagtgatcggcacataatccgacacacgcctatagacagacaaactataaacagagaaacccgaagagaaaaacaagcccacttctcatctattagctggtttcatctgttttgtcccacacaaaaaaagaagaaatcacttcccttgctttccgctgcgatttacggaaaggaatgaaaggatttcttctttcttgtcttttcgactaaaaataaattttagaaagggtatttcattaaattagaggtattttttaaatgtgtaattacttattgatatacgttactttttaatataaattactttactgcgttattatgagttttttatatgcgttactatgcgattactataattgcttgttactattttttactatgagttactacgagtttttctttgaatgattctacactcttatgcgttctgagccagctgttcgcccagttcttcgcactgtttgattgcatcatcatctggagtttcctggcagatgaggccttcaccgtttaataccgttgcgcctgctgctgtcattctttcttcccagtctctcatccactggccatctccccagccataggaaccgaaaagtgcgatggtttttccctgtgcgaagccttctacttcttccacaaatggttccatctccatctcttcaagtacttctgcgcccattgcaggacatccaagtgcaaatacttttgctgcttttaagtcttccatagatgcgcttgagacttctactacgtctgcttctttaccggcttttgcaattccggctccgacagcttccgccatagcttctgtgtttcctgtctgagaccagtacactacgctaatcttgctcattgctgcttcctcctgaaaaaaattattagtttgatttaccatgatgtttccatctttgaaaaggtcttacaaggaactttaagccgcgccatccagcagtaaattactactgcagctttcgataacatttcttattccgataccttgcgataccagttcaatcaacgcttccttcgcccggtcaaatttgtaaaacagttgctttgcttccgacaggtctccataaaccttccagtaaccagaatagagataatttttcccctcattcaccacaaatcctttgacatcttctgcaggataacctaacagtacaccaatttcatggggaaaatctttccctttctgcacataagcttcatatcgtatctgaactgctctgaggatatcagataatactttaccgttgtatcctgcctccctgagaagtactctgttctcagctttcgtaagccagacagttaagcttgcttcccgatacaggaaaaatgttgtcttgcattctgacttcgctaatctcatataagaaatatccgttccatcaagaatcgctccaacaaactcttcgttcttagatggaataatcaaaagattcgccaccttaagtccggtaatcaacggcgcacactgcagggccatctgtgttctgatattatctttgtccatcttctgtacaatctcaaatacttcctgtctcatggtgcctccttgttttaatgtttgttagttattactaacttgcatttataataactaactttcgtcataaagtcaatacccttattgatacacttttctctataagagggtattttgcatctttttttgaaaaatattcaaaacagacgcccaggaagaggtcacaaatataggatatattttctgtttcatttttggctttgaattattttttgaagtgttataaaaaatatgtatcaacctgacttgggataagaacagtccatatagaaataaatatgcgtctcatcctcaaatcgtcctcccactgatttaatttaatcaagtccatacacagtcagcaccccgaagaaaaaagataccctatatttatggcctcggagcaaggtttggatgcgagccataagcgaacattcaaaccgccacgactaaagtcataaatatagggtatcttttctcttcggggtgcgtctgtcccgctaataaatcaaatcatccctactcttctgggagtaggtttttcatactgtttaaactaataagcagtgttgaaacattatgacataatgctgatgttgccggagctaatactcctgcaactccaagtacaatcaatccagagttaattcccacgatggagcgataatttttatgaattcgttttaataatgcattactaatctttttcaatgctacgacttcatataaactttctgcgctgatcgtaatgtctgcgatttcttttgcaatttctgcgccatcacttacagcgattccaacgcttgcggcagaaagggctggtgaatcattgatgccatcaccaatcatcatgacctttcttcctttttctgtttcctttgtgataaagtttgctttatcttccggaagtacttcagaataatattcatcaacgcctacacgttttgcgatggctgcggcagttctctcactgtcaccagtcatcataacaacttttgaaatacctgcctttttcagagctttgattacatcggctgcttcctcacgaagagggtcttcgatacagattacagcagcaagtgttccttctaatgcaagataaaggtgggaatactcttctggaagagcttcaaatttcgcttcttctcctgctggaatcttacaattttcatcttcaaatacgaaatgataacttccgattacagctgttttcccttcaatcgtagtagaaataccgtgtgctacaatatactgtactttggaatgcatttcctcatggtcaagttctttctttaatgcagcatctacgactgcttttgccatagaatgtggaaaatgttcttccatacaggctgccatacgaagcatttcatctgcatcattgcctccaaatggaacaacttccgcaacagtaggctctgcctttgtcagtgttcctgtcttgtcaaatacaatagtatctgcttctgcgacagcttccatgtacttgccgcctttgacagtaacattatgctggcttgcttcacgaattgcagataatacagaaattggcatagcaagttttaatgcacaggagaaatcaaccataagaacagcaattgcctttgtggcatttcttgtcgctaagtaaacaagtcctgttcctgcaagtgtgtatggcacaagcttatcagctaaatgttctgccttaccttcaagaccagactttaacttctgggaatcttcaatcattgtaacaatcttgtcataacgtccacttccgccaaccgcttttaccttaacagtgatttcaccttcttctacaacagttcctgcataaacagaagtctcctctgactttctaaccggcatagactctccagtaagggatgcctggttcaccattgcctctccagctaatacagttccatcaaatggaatgacgttacccatgtgtacaacaatgctgtccccctgtttaatctgggaatatggaacaagaacttctccgtcctcggtcttaagccataccttttctacattaagtgacatgattctggcaagatcacccacagacttcttatgcgtccaatcctctaacagttcgccaattccaagaagaaacattacggaaccggcagtatcgtaattaccacgaagaatagaaacaccgattgcagttgcatcaagaacgggtacctctaacttacgctgtgcaagtgtctggagtcccttccaaatataacctaatgattttattcctgtatacaccgcacgaaatggggctggtaataaaaactttcttgcatagtgtgcagtaatctgtccaatcagcttctcctgaaattcacgattcagctctcttccagaattctcaataagaccatccggaacttctaccttatcgtaaacgaacttctgcacttctttaataatattctgtcgtacgaaaccatctttatctgcagcataacggacaactgcatctgctgttctctcgtaaacctttgcagattctacgccttcgatattctccagataatataataaaatgtctgcctgttcgcaagacatctgtttcttctggaatatatggagacgcattcttccttttatctcgtgttttatctgaaacttcaaaatatacacctctttatttatctgttaaaaaaagagaccgcctctgtcctgcagtctcttctttacttttaaagctacatccattttaaatcaaattcaaatttttgaatctaacttaatatcgactttaaatcaacatcgacagtcagccttaccacaatatgttttaatataaatcaaattatcaaaactattctgctgcttctgcctcagcttcaacttcttctgttgtctcttcttctgctgcttcagcttcttctgcaaactccgctgccacttttgcttctgcacgttcttcattaatctgttttgcgccttcataaatatcttcagcgttctcctgaacagttgtaactgtattcataacagtctcttttgctcttaaaacggctgctgtacagtttgtataaactttcttagcatcatcacttgctaaaaccttgatacctgctgttccaaataaagtacctgatgcaaataaacccacttttttccagttaattttagttaaacattctaacatgtccatgacctcctgataatattaatattcttatgtaaaagtacaatcacttttcttttcacacaataataagccaaccgagggggaaattacaagtaaaaaatccaataatgatattttttctcaattatcctcgcttagcgttatgtattctcaataagtatttaattgttgtcatatttttgctttagacttcattatctagctatccaaaatatatgatataaaaatgtacgctacaatcaataatctctataacttaatactcaggctaatacctattcaaactttctatctcttttttaacctttcaattatcaatgttgaaacatagctttaaaccataatcttatttgccatatcttttccaatggcaactctggaatcttttacattcacaatcatattgccattaatctcagaaacaactgtaacggttccgccaacaacaaatcctaatgtctctaagaacttcttcgtctcctgttttccaccaatctttttaattgtcattggttctccctgacttgccatcgttaatggtaacataataacctctttcttttgtatgtttgctaaaacttacttttatttcacgcattcttatttagttagcataccctaatatctattagaagtcaataatttatttgagaatttttctcaacaattagtagtttggataaacagacgaacccgaacagataaataagctctatttatctgttcgggttctgtgctttagtaaattagcgcttcaatacttttttcaaattttttaccgctctcgcacttgttttgcttttcagatcctggtagtcaaagaatgcaaaaccgtcacaacctttttttctagcatactgtacctgctttttgagaacatttgcatccgatctccactcccggcgttcgcttgaacttgcaccggtattatggcctgcgcggtatacagcaattcctatgtatacttttacttttttgctttttgcagctttcatccaacgctttgtcactctgtcaaacttcgcatacggatgtttgaatccccagtaaatctgtggacaaatataatctacataatcatgggagtttaaccatttattgatatctacataataagaatatttgcttgttaaattatcaatatttcctgccgggctaattccaaatgtcacatttggctttgttgcttttactgcactgtgaatcgctttcactaaagcattaacctgttgtcttcgaaaagcaacaatgccatttttatgtttgcccatagtagaagctttgtattcttttgcatcaaaagcagagtttacattggaagaattaaatgttgggtaaaaataatcatccatatgaattccatcaacatcataattctgtacaatttcttttgccccgttcacaataagttctcttacctgtgcctttgctggattatagtaaagacttccccgataagcaagaacatttctgcgtgtctttttgttgttatgccactttcttgccagatttttagaagataaacggctataattggtggaacctgccgctacacggtaaggattaatccacgcctcgattttcattccgtttgcatgggctacagaagtcataatttttaatgggtcaaatcccggattcttcccctgtttacctgaaatgcatttggaccacggaaaatatttggacttgtacatcgcatctccaaacgggcggacatgaacgataatacagttcattcccagacttttcccctttttcactaccttcgtaaaatacttcttaaatgtagatgcatttctctttttatacttggtacgataggcatcatagtcataataagaaaaccagaatgccttatattcatctgattttgccattgttccgaccgtctgtgctgcctggcttgccgaatttcccgcagcatttactgctatgctgccaaaagtatttccaagtaaaaagcaagtcagtaatacaaccagaaaaagtttacctttttttaacatactaaatcttcattcctttcctctgtgtataactctgtaatatatcgtatatttctacctcacaagaaaacaacagtctctttttaaaagcgagcttttcagaaataactttttcttgcttactgtaaagcaatatatacattttaaaatagaattgttcaaagctatacaaatttcaattgctacaagattattaccaaatcaaaaatagttatagcacatatttttgtcagaataaagactatttctactctttctccctgattttcttaaacaactgcaccctgtttcgaataccaagttttcgataaatatttaaaatatgcttttttaacgtattgatactaatagataagtaatcacagataaagctattatcttttccttccattaacaggtgcagaatgttatgttcctgtcttgtaaggccaaatttctctgtcgctgctgatacggtaagtttttcaccaaactgtatacggttctgtctctgctgccacagacgatatgccatatgctcctttaacgtatccacaagaaatacttcatcatggttaaaatcatcttttccaatatttctatataaggtaactacaccaagaaactgcttatcctttgctataatcatctgtaaggaataatgccatctgttcggcttatatactttgtcataatactccgtttttgtccgcacctcatctgccataatatccgtctctctgtatacgatactttttccgctatataaaattccgcgcccataatcaatggtatcatatacatccgataaatcctcgtcacaatgatacataaccggtgctgtaagcttatgctcgccgtccgctgctgccagataaaaatccgcactgtcaaaatctacaagcattttcatctgctccaaaaacttttttctcattccatcaaaatcggctgttgtataaatctcataaataattgaattcaaaataagccagtcatttgtctgtaaagtattcacacatatcacctctctatgtattacactcattaaagcatatcaagtatctactcccaaagaagtataaaagaaaaagaaggtatacttattcttacataaatataccttctttggccacccctgtaaatatttattacttctttatactactttattatatccaaaataagaagaaaatcaagagtaactcgcactttatcctctttttacgacctttctcggaagccacaacaatttgtttccaagacgatatgctttagactgcttaatattgtctatttctttttgtagcttttttttctcgccctcaagttttttcttttcttcctgcagtttctttttgtcgctctgcagagtctttttatcctctttcagtgcttgcacattttctcttaacactgcattcttctctcttaagatcttacggcgcacattattattctcgttattaacacgtcttgtaatactcttttgtacgaggaaatctgccggttctgtctcatacatcttctgcatatctttatacatccacactgcataaatattctcttctgtacattcatctagtccgaactcatgaaaaccttcttccacaagcttacggtaaagtttctcataggattcaaaagttgtctgaatattcaatgcatgataaaatccgctcaaggcacgattcaaaaaactgaaccggacaagattaaagtctggatacttctctatatgttctttggcatacagccatgaatcataagcacaaaatacggtatcagaagccttgcctgataaactctcatcattatttaccctgtaagcaatgagcacatctttcacatatgtgattctctccgcaagaaataatgccataatcgtaaaatacgtgtcattcgcctgtttgattgcctgatattgcagcttattttttgttataaattctttgagatacaacttattccacggtacattatttgttaagttaaaaatgtaatctggaacatcaaacttattaaacgtctgctttcccggaagaagatcttcttttaaatatgcatcagaagggatatatttttctttcgcattatcatacttgcgagcctcacagatacatatatcggagttttcctgttccgcctgtgcatacataacctctaatgcattatgctcaaataaatcatctgcatcccagaaaatcacatactttccatgtgcctgttttaaaccattatttctagcaacccccgcgtactgattcttctgtctgatcagctgaattctggaatctttctccatccattcttcaataatcttacaggaattatctgtagaaccatcatccacacaaataatctctatctctcgcaaagtctgacctgtaatatcagaaagtgtgttatctaaaaattcatctacattataaacagggactacgactgatactttaattgcttccattgtttcctccctcttttcttaatatccatttgatattcattttaacatctgctctgaagcatgtttagaaaatgctctaatattcatacaaacaaatatgacactgccaatggtatcgacagtgtcatacttacattgctattaagattataaaccataagaaactatacaacaagaataattaagagaatttaagaatttgttttcattctttcttaattcagcatttctatgttataaagggcgattttccccttctgtttcagattctttttcctcacgcactgtcaaatatatcaaaagaggagtacacgccataagaggcagagcatatctcaatagtccattaaccggggaagcaatacatatcaatatattgatggctggcccaattaataataatatatcccttgttctctttctatagattaaatatcctgctaacaacagtaagatccaagtataaaaaccagggtcaacaagctgagaaaatcccggaaccttcttccatatttgagcatattctgcaagtactgttcttatttttaccggcgtaatgtaatggatatcaaaatatcctgttgccacaggcgctcctttaatataaaactgataatctcctaaaaccttttcattataaaaaggataataataactaaatgtattatttaatgtagcttctatatataccattggatgttttaaaaacatttcaaaccacactttaaaatattcatctaatttatcttcagaaccttctctaaaagtattttttacaaaatctgatatttctggattataattttctttaatcccatcataagataaaatatcatttatagcttttttctctttcaaagtaacttcttctggatattcttttatatatcgagctgtctgttgaaatggaatagaaagtacttcttttactgagcctttttctactcctagctgcggtgccacataaccttccagtccctgatagcataccataagacatatcaggaggataacatatctgcttctttccttctgtacatataatgtcaaacaaaccattgacggaataacaatataaacaccattattcctgcttaggcacaccatcattcccaccaagaacaaaattaccatcttttttatttcaatgttttttccatgctgtatacaaatatcaatataaataataaagaacagcgccagcaatgccgtgaaaatattatctttaattacagcctgtgcatagccgccaaatgccggaacgaccgaaaaaaacaccaatgttcctatatacacttttttcgatgcaccccatttttttaaactattacatacagatgcataacataatatctctataaccgtaaatatggctactatcataaatatgccaaagttatcactgatgtatcttccaattctcataacaactccatagataaaagtaattacccacggatgatggtttgtcaaaggattaattccaaatgccatatttaactgccaataaccatcatgcggtactgatcctggcaaataacataagatataaggactccagcatagtagcatacataaaaaagaaaaggcaaagtaatgttcctctatccatttaatttttattgacttttccttctcctcgctcttctcatttatatatacatataaaagtgtaattgccacatcaaataatatataaaatccaaaaaagactattacagcaatacaaaattgttttatatctccaaaaataaattttatgtttcccgtctgagaaaaactttttcctataagcatacagcaagaaaaacacactgctaatatatgtgttatccatttccgtcctgatatatatatgctccagctctttctatataaaatcattagtaaaataacgatgacaaatgcctgctctttttcaccgctaagttctgcagcaagttttgcccagccgccaattataactgaaaaccgtcctgaaatacacaaagctaccgccgataaaatcgcatacactcctggtttaattttgtctctcatactacactcctgcatcattctttatatacctctttattttccgtctattttatttccaatcagaaatacgaactttttaaataaaataaatcgttatttcaatttttatatttttatgctaatattatacaatactttatattatataaggtttactatactatctattaattttatacgaggtaataacatgaaacgaaatccatctattgaactttgcagacttctagcctgcctgattgtaatcggagtacacaccagtctatccgctgctgtaaacgagcatagttgggatactttccgtctttttctaaattgtctgttagctgatggcgtagctatcttttttatgatcactggtgccttcctcttcaataatgactattgcagattattaaagaaaaccctaaaacatatcatcattccgttaattatatttagcattattggtttctattgttttgactggctatttgataaacaacctctttcattacatattgctgcctctaaatacattgatacctttcgaactcttctttcctggcaaaatccaattagccacagcgttcacttatggtatctttatgtttatattttagtaatccttatctatcctttgcttaaggcatttgtagattatctggatgctgatacaaatcgaacaaagatttttttaataggaacatttatatttttaatcatgaatgatatttcttcgaatagtctcggaacattttcccatcattcaataaatgctctagttcccgcttctattgaaataatctggggacatattctttataaatatcagaagatttttacccgtaaacttgctataccagtttccatatttttgtttttctctctgaattaccttaggagcctcattcagcttcacagatattcattagaaacaccaaataactatattctattttggtatagttctattggtattatctgtgcttctgcaatatttattttttgttgctctgtcatcaaagcacctgggtcttcaaacataattcaaaaattcatatgctggctggcctcttatactttcccagtatatttaatccatatccctataagagatttacttgcaacatacaatgtacctactatgttaaatcattttatgttctcccatttttccgagttcattgccgacattttatataatagttctattgtccttatcatttttgttatctgtctgataatttctattttgtttagaaacataaaaaaacttctaaacaaagttatccattgtttcgcttagtgaaacagtggataacttttatttattatacttttccaaaacaaatcttcccagaaaatgcttctccagctgtttcttttcctgttctaactgctctaaacgctttgattttttttctaattctgcttttgtatcttttaaatgctttcgcagttttttaagcttttctccgcgttctgttttttcttcatatgcctttttcagtttggcattaatctctgatttctcagcgtatgttctttgtagtttttcattaatctctgatttctcagcatatgtctttttcaatttctcagatactttttttctgtctacttcctcaatattcataaagaaagccattcctataagtaaatataagggactatttttttctccaaaaagttcatctctttcactttccggcacttttaaataatctttaaaaatattgatataggttcctcttattcttttataaattgcctcctgcaatgcagaattctgtttttcatcttctaatatctgcattaaacctctaacgacctccaaataggattcaaaacgaatttttctttttccaccggtcattatcgaattgcctctaactcgtcttaagtataaattatctctgacacatcttgctctggctgctttaatcatagttcttacagtatatagattatcctcaaaatacctttcttccccaaatttgatattattatctatcagaaattgccgacgcacaaattgtaaacaaactgacattttaatatcgcctttattctccatctcaatgtacagatttttaccatcataaacaccatcatactctttatgtctatgatataatgtaagaaattgaggaaatgcttcctcaatttcttttgattcgtaaaaactttctgcctcaaaatacagaatatccagactatctgcttctgcatattgatacaatgtctccagacagttttctttaatcaaatcatcaccatccaaatagtagatatacttgccccgagcacgctgaacacccttatttctctggtacgcaactccgtggttttctcccgtaaacacttgaatatatggatataaactctgatatttatttaatatttctaaagttccatctgttgaaccatcatttaaacaaataatctcgtaattcttaaaactctgatttaacacagattttaatgtttcttccacatattgtcctacattataacaaggtattatcactgaaattccatactcttttttatcggtactcatcgctgtctcctttctgtctatctactcacaacgtctattcttcataataagcattaaactcatttgattttatcttaagatatttggcatactctttcttatcataaaatctttctgctggaagagaatcaattccaaattcagcaaaccattcattctttaatttattaaataaaacttcttttttcgctcccgttatcgtatctaaatgccataaactaaaatgtaacgcatagttgatataatcctgctcgaactcccagaagtttccatgcgctgtcaacgcatcctttaatgcgttcaatgcagtgtggaagcaatcccatgacttttctctggtattagagagagaattcggattattcctccgttgatgtgccagaacaagatctacaatctccattctctgtgcaaatgcaagcgctgaaaatacaaataacatatcatttgatgttcgaatctgctgaaacttcagatgattctcctcaacaaacttgcgctcaaacagcttatcccaagcccatccgacaaatactttgaatatatttccggtaaaagaacggcaattcatcggacgatatggcggaatctgcttttctcttaaggtccacttaacctgaacaaattcgttcagatcttctctgtactgatctgaacgaaatactacaacctgtgcattagagcttttgcccttttcataggctttttctaacatatccggctcaaaaaaatcatcggaatcaagaaaagataaatattctccggtagcgattgccaaaccattatttctggcagctcccgctcctgcatttttctgttcaattactttaacacgtttatcttttgcttcatattcctttaaaatttctaaagaatcatctgttgaaccatcatctacgcaaataatctctatgtcctttaacgtctgtcctacaatgctgtccatgcactgacgaagatattcagacacattataaactggtaatataacagatacctttacgctcataatttctcctttatttattgcctttaaaaagcgccttaatctttcttggaattgttaacataaaccatccaagtctgtaggatctggaacctttaataatcttaatatcgttttgaagttttgcgttctgtttttctaacttttctactttcttagtgagtcttcttacctttaccggagtagccacctttttcatatagaagccattcggatccttggtaataaactgaatattagaccagctaatctttgtaaatacggattcgtctaactctcctaattcaagtccccgcttaaactcatcactgaaacgatgaacatattctctcttatattcttcaccaatacgcttgatcgttcccatataattgttatacttctttaaccagtacattgaacggaaacgctcccatacctctttatctctcaccagcaactctctgatatgatcatactcaacattcatgcagtataccttttctttgttatgaacggaagaattcggattatctcttcgattcatatagtatggcttatcaatgatcattccacgctttgcataggcaaatgtctggaaccagaatccattatcctggaaagatgcaccaggagtttcgttatgacgaatatggaattcctcaataaagcttctcttataaattccgctccaggtattcataatataacggattgctttcggtgtttcacttggattgaacacgatattataatcttccttatttggtgataaatgattataaactaattccatatcctctgtttcactgtctcgtttaaaacgatagaaatctgccttaataaagtctaaatcattctcaacagctttttcatataaatcactatacatatttaacgggataaaatcatctggttctacaattccgatatattctccagtcgctttatctaaaccgatattcattccgattccataaccaccattctctttatcaacaagaacgattctgtcatccttttgcgcataactctttaagatctctaaagagccatcggttgaaccatcgttaatacagataatttcaatatcttttaatgtctggtttacaacactctccatacattctacaagatacatctccacgttataagtaggtataataatagatacttttgccatttcctcactcctaattaattattcttttctttctctactgcttttaatgccgctgcaattaccttgtccatatcataataacgatattcgccaagacgtccgccaaaaataacattctcttctttatctgctaattcacgatacttaccggcaacttcttcgttcttctcattattcaccggatagtatggttcctcaccaagcttccattcactcggatactctcttgaaataactgttttgggctgtgtaccatactcaaaatgcttatgctcgataatacgggtataaggaacttctctctctgtatagtttactacagcgttaccctgatagttatccatatctaatgtctctgtttcaaagcgaacgcttctgtattctaatacaccatatttataatcaaaatatttatcaagcattccggtatacactgtcttctctgcgatacccgcattctcttttctaaactcataataatctgtattcagcaatacgtcagaaccttctaacatcttctcaacaattgcagtatatccacccataggaattccctggaaacggtcattaaagtagttattatcataaataaaacgaagcggaagtctcttaataataaatgcaggaagatccttacagtcacgtccccactgtttctctgtataaccctttactaacttctcatatacagaacggccagctaaagaaagagcctgttcttctaagttctttggttctgtgattcctaattcttcaatttcttcctgaatttttgcttttgcttctgccggtgtcttaataccaaacatcttgctaaatgtattcatattaaatggtaagttataaagttcatctttatatcttgctaccggagagttaatgtaattattaaactctgcaaactgattaatgtattcccaaactactttatcagatgtatggaaaatatgagcaccatacttatgcacattaattccctctacattctcacagtaaatattacctgctatgtgatctcttttatcaattacaagacatttttttccttcttttgtcatttcatgagcgaaaacagcaccaaaaagtcctgctcctacaatcaaataatcatattttttcatgatttctccttttacatttttctccaaaaaatattgttctgtaatatatccgtaatattttaacatgatataacatttttttcaattgacaaacctcttaaataatcttatgatgtacattcttttcttgactttttaacacactctgtttacaattttactaaataatgttcaataaaggagtgtattattaatgagttcttataaaatagcgattgccggaaccggttatgtcggtctttccaatgcaatccttctttctcagcataacgaagtttatgccgttgatattatcgaagaaaaagtaaatctgatcaattccggcaagtctcctatcgtagataaagagattcaggaatacctcgctacaaaggatttaaatcttacagctactactgatgcaaaaaaagcttatgaaaatgcagattttgttatcatcagtactcctacaaactatgatcctaagatgaattactttgacacttcaagcgtagaagctgttatcaagttagttcttgaatacaatccaaacgcgactatgattatcaaatccactgttcctgttggatatactctttccgtaagagagaagtttaacacagagaatatcatcttctccccagaatttttacgtgagggacgtgctctttacgacaatctctatccttccagaattattgttggtgcaccgttagatgatgaacgtcttgtacaggcagcacatacttttgccggtcttttaaaagagggagctatcaaagaagatattcctgttttatttacaaaccctacagaggcagaggccgttaaattatttgccaatacttatctcgcactccgcgtaagtttctttaacgaacttgacagctatgcagaagtacatggcttaaatacaaaacagattattgatggtgttggtttagacccacgtatcggtacacattacaataacccatcttttggttatggcggatactgccttccaaaagatacaaaacagcttcttgccaactacaaagatgttcctgaaaacttaattgaagcgattgtaaaatctaactccacaagaaaagattttatcgctgacagaatcttagaaaaagccggatattatcacggtactgccggacgtgacggcactcctggtaatcaggttaccatcggtgtataccgccttactatgaagtccaactccgataacttccgccagtcttctattcagggtgtcatgaagcgcctgaaagctaaaggtgcagaagttatcatttatgaaccaactttggctgatgatactttctttggaagcaaagttgaaaaagattttgacgctttcaaggcaaactgtaatgttattattgcaaatcgtttttccgatgaactcgctgatgtagaggacaaagtttatacaagagacctcttccgaagagattaaatcctgatttgtgaggctacgaagcagacgaactccagaagccaaaataaagcatatttgtgactttagtcgcggcagtttgaatgttcgcttaaagcgctcacatccaaaccttgctccgaggccacaaatatgctttatttagcttctggagttctgtgtgttggcaactcagaaaatcagttggagggatttggagaagaaggttgaaggtatagaaatatccagaaaattaaattctataggattgatacataaactattatcatagtaatacaataatttatgggtaggttactactttcttatgaactggaaatttaaaactgtttatagctttatctcttaaaaagtgagatgttttcattgaaaacgcgaaaaaaaactacaaaaaaactgtaaaaaacaaataaatttttaaatcaattccagtaatggtttaaacgtcagttctttagaattttaactcctcggaatgccataaccatctgacgcccctcaaatctctccaaaaataaattctgaatttacttaggcagccaaaacacagcccacagggaatataatatcctatatttgtggcctcggagcaagtgttggatacgagcgaatagagcgagtattcaacatgccgcaactaaagtcacaaatataggatattatattccctgtggacgtctcctttgctacgcaaatcagaattccctacctcacatgtttggcacttgggtatatccgttccattcttgtgtctggaaatctcgtatctaatattttcgttatggcggtttcgggtgtctttgcactttggtgtctttcgtgataacggtttaatgcaagacctgagattgccatatcgaataccatgaatacaaccaagaaccaggttaatggtaccccgattttctttggtatcttctcaataaatcctgatagtttcggatataatattttcatccagactacggctgcgattccccagaagaaacagtacaataagttgattcttccacccagattaaatggaattttgctgtaatcccagaatacggttccaaagacaagctctaatacgacactacatatatattcgtaagcaccgccgaggactgttccgaatataaagatgaagctgtcgcttctatcgcgatattggtagagcatataggtgaggaaaaaacagccaattccccagacaaggctaaatgggccataaactacactgcttcggcttgtgatagtgcccatcttccaccagcaaaagatagtttctgtaatatcgccaagaaaagagccaagaaagaacagccagaacagtttgtaaaatccacatcctgctgcaaatacaccagtcatttcctgtgctttttctcgtctttgcagtttacttcggatgatttccttgatttcgagaccctcatggcttttttcaagatgttttaacacccagccagtcagaccatttcccatgtaatctgcagctttttgtaagttatcagctacttcttctacaaggactagttttcctaatcgtgccaggcggatatgtacactcagaattcctgaaacagttccgataaaatcaataatgattattacataggcaataatcaaaatgacttttcctaatccatatggaagtattccaataattttacttaaaaatggatttacaatccaaatacacaacagtgccgccgcaccccatactaccgtataaggtaagttaacatagccaccaaagttaaatctccgtctggaataatctttccatttctgatggaaaatacgttccagggtcactcctgtaaaagatgtgataataaatgaaagaatcactcctcctgcaaataaaaatacaggctgatcttttaattctggtaaaaataatgcaaaaccaacggctccaaatccgtaggatggacaccacgggccaaataaaaatcctacgtcaataaactttttttcttttaatgctgctccagaagttcctattacccatcctgcaaaggaatataacagaaaaaaccagaacacttcataccaggtatagctcaaaatttttctcctttttttgaatttgtgatatactatatcatatttttgtgaaaggagaaagtatgtgaatccaccaaatgctattttacatgaattactaaatcttgcggaaattatgctgaccaacggtgccgaggtcagccgtgtggaagaaacgctaaaccgaatggggcatgcctacggtgccacccagatgaatgtatttgcaatcacttcaagtatcgttgtcactatggtctttgaagaaggcgaagaatatacacaaacccgaagaatcactacccctgtcggtacagatttctttaaattagaacaggcaaatgcactcagcaggcgctgttgttcttctcctctttcccttccagatttgaaatatgagataaataaaatttcaaaaatcagtcctgctccttataccatttacctgggaagtatgcttggtgcaggtggcttttctgtcttttttggaggaacaattttagacggagccattgccgttatctttgcctttctcctttgctttttacaaaggcatttaaactctatatgcagcaacactttaatcctgcagtttttctgctccctttttgtcggctccggcatttgtgtagctgcacatttctttccggtaattcatgcagacaaagttatgatcggtgacattatgctgctgattcctggaatccttatgacaaactctatccgtgacattttaatcggtgacacgatttcaggcgtgatgcgtcttgtagaatcgcttctttgggcgggagcacttgcctgtggatttatgtgcgctatctggtttgttggaggtgtgttatgatattacaattttttgcagcctttattggagctgccggcttcggcttcttatttcatttgcaatttaagcacattttccctgccgcattaggtggtgtactgacctgggttatctatgtcatcgcaactatctggggatttgatgttttcatttcttctctatttgccagtgctttcgccgcaatttactccgaagtcatcgcaaaaataagaaaagcccctaccaccttatttttaatcatttccgttgtcgttctaattcccggcggctctctctattacacgatgagttatgctgttcagaaaaaatgggcagaagcagcagcttacggctcccaaacattacagtgtgctttaggacttgccattggaatgagcctcatctggatattccacgatatggcaaggaaggtttactatttaattcattaagagacagacgcccgggaagagaaccgatggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgctcaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaagaacacgaaaaatataactatccaatcctgttattatgtgaaataggaggaatcgccaggtcatcctactacaaatggctccatcatgcagagacaccgaatgagagatttaacgaggaattggcagagaagctggaacgattacatgaaaaacatccagatatggggtatagaaggttaaatgacaagctgcgccacgatgaagatatacaggtaaatgataagaggatcctccgtatttgcagaaaaaaacagatccggtccaacttaaagagccggtataatggctgtaccagagcctcaaacaacccagcatttattgcagaaaacattcttaatagagaatttaaggcggaacaccttaatgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcacactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccacgataccctatatttgtgactttagtcgctgcggtttaaatgctcgctttatgcgctcgcatctaaaccttgctccgaggccacaaatatagggtatcggttctcttcccgggctgtctttggctggattttgtttgaattaaatagtggttgtggggatttgggggagagggtagaagttttctgcttgctcttaaaatattgtagatagatattttttatcccagtttgattcgtttatcttttattgtaagcttctaaaagattattcctaaactattattactgattggatagtagactagatttcaaacaaatttggtgcaattattatgttatcgtccgcaatatttataaaaccaaatttaaaatgccgatttcttcattttactattacatatagtcaagtcaaatcatcccctattcccagtcattctcgagtaagcagaagacatcagcttctgtccccaaatcccctcctcctatttaattcaccttctccagccatagcacagaagccattgccccgaataaggcatatttgtggtctcggagcaagtgttggatgcgagcgagtagagcgaacattcaacacgccgcgactaaaatcacaaatatgccttattcggggcaatggcttcgtctgtagttcgcttaatgaattaaatagtaaccccttgacattttgttctattttgtttatagttaggatacttatacgactgacggaagtaagtggaatgaaccacatgaagtataagactcttatagccgaccgtctgggcaattcttgtctggatgctggcttttttatttctgataagataatattctatccaatatccctgataagaagtaactttaaatcgttattaagtcatgtgctaaagaagatgtttttccaaacatgctctaaagagcgaaaaataaaattatagttgtatgcttgtcattattgtacttatatcagtacatttgtacgatttgataatattttatcaacgctctaaaaccctttattttaaaggctctacaagcatttttgtgtatatgttcaaaaaaaagaacacataatatcaaaaaattgtttgacgattgccaaaaatcatgttaataatgttgttagatgattaaaacttaaataagttaaaactaatcatagtaaatcatctgaacaattttgttgattttttagcaaacatatttcaaaaccttgacttaaggatttttttaacaaacagggaggtcaattaagatgttacaaaaagaacaatggcagggatttaatggacgaatctggagagaagaaattaatttaagagagttcatccaggataactacactccatatgatggagatgcttctttcctcgaaggtcctaccgaagctactgacacactgtggggcgaactgcagaagctgcagaaagcagagcgtgaaaagggtggtgttcttgatatggatactgatatcgtatcaagccttacttcccataaaccgggttacatttctgagtctttaaaagagaaagaacagatcgtaggtcttcagacagataaacctttaaaacgtgcatttatgccatttggtggtatccgtactgctgaagaagcttgtacaacttatggttacacaccaaatccagaattccacaagatttttacagattatcataagacacataaccaggcagtatttgattcttatactcctgaaatgaagaaagctcgtcacaataagatcattactggtcttccagatacttacggacgtggacgtatcgttggtgactaccgtcgtgtagctctttacggtattgacctgttagttgctgacaagcaaaaagatttcgcaaactgcggtgacggaacaatgacagatgacgttatccgtttaagagaagaaatctccatgcagattaaagcattaaaagatatgaaagttatggctgaaagctatggctatgatatttccgaacctgcttctaacgcaaaggaagctgttcaatggacgtatttcggataccttgcagcaatcaagacacagaacggtgctgctatgagtatcggacgtatcgctactttccttgacatttatatcaaacgtgatatggataagggaatccttacagagaaagaagcgcaggaattaatcgaccatatgactatgaagttccgtatggttaagttcggacgtatcccagcttacaaccagctcttctccggtgaccctgtatgggcaacacttgaagttggcggacttggacaggacggtcgttccatggttacaaaaactgactaccgtttcctccacacattagaaaatatgggaccatccccagagccaaacctcacagtactttactctgagcgtcttccaaaagcatttagagattacgcagctcatatttctattacaacaagttcaatccagtatgaaaatgatgatgtaatgcgtccagtatggggcgatgattactccatctgctgctgtgtttctgctacacagactggtaaggaaatgcagttcttcggagcccgtgcaaaccttgcaaaatgtctcctctacgcaatcaatggtggtgtagatgaaaagactggtcagcaagttggtccggaatacaaaccaattacttccgaatatcttgactatgatgaagtaatgcacaaatatgatatcatgatggactggttagcaggtttatatgtaaatacattaaatctcatccagtacatgcatgacaaatattactatgaatatgctttgatggccttaatcgatacaaatgtacgtcgtacattcgctacaggtatcgcaggattctcacatgtagtagattccttaagtgcgattaaatatgccaaagtaaaaacagtccgcaatgaagaaggacttgttgttgattatgagacaactggcgacttccctaaatacggaaatgatgatgaccgcgctgatgatatcgctgtatggttacttcagacatttatgaagaagcttgaaaaattccatacttaccgtgattctgaacctacaacttccatccttactatcacatcaaacgtagtatatggtaaggcaactggttcccttccagacggaagaaaggccggagaacctctttccccaggagcaaacccaagttatggcgcagagcagaacggtctcttagcttccttaaactctgtagctaaacttccttatgaatgggcattagatggtatttccaatacgcagacaatcaaccctgatgcactcggtcattccgaagaagaacgtattggtaacttagtaaatgttatggacggctacttcgcacagggtgctcaccacttaaacgtaaatgtatttggtgttgagaaactgattgatgcgatggaacatccggaaaaagaagaatacgcaaactttacgatccgtgtttcaggttatgcagttaaattcatctctctgacaaaagaacagcagttagatgtaattgccagaacatgccatgacagaatgtaataaaaattcgatggctcttgttcattctacggagagttttggttcggtggatgggccgggggttcgttttattgtttttttgcagggctgccctttgcggtgtcagttctgtcacaatccagatacatggaagatgacagaggaaaatggtgcgatatggaaaaacgcagaggagctgttaaatcaggcactccgctatcgtccttactggaaaaatggcggaggtattactgtcagtggtggagagcctcttttacagattgattttatgcttgagttctttaaaaaggcaaaagaaaaaggaatccacaccgttattgatacagctggtggaccttttacaagaaaagaacctttcttttctaaatttcaggaattgatgaaatacactgacttgttattagtagatatcaaacacatcgatactgaatgccacaaagttttaactggccacagtaacgaaaatattcttgatatgattcgctatctttccgatatcaaaaaaccgatttggattcgccatgttcttgtaccggaacgaagcgataaagatgaatatctgactagattagctgatttcattcactctcttgataatgtggaaaaggtggaaatcctgccttatcatacgatgggtatttataaatggaaagaacttggattagaatatcctttagaaggaattcaaccaccaacaaaagaacgggtgaagaacgctaagaaaattcttgctatttgatttgccgacaaacaatgtactaaaagaaaaatcccccatatttgtgacttcgaagatagattgcgttgaatacttatccatctttaatctatccttgaaatcataaatatggagaattttgtctttaaatataaactttagttaaactccactcaaattaaattctctttctccaaataatctctaaaatttactttactcttattttctttactttgctccatggaccaaaatatttcttattgcctatttttttataagaacgtgcttttacatagtaaattttcttagaatctaattttgttattgtatatgttacctgtcttattcctttctttgttaataccttcttgcccttgctaaattttgagttcttagctgcaacaatctgatatcctgtagctttggcatctttctttatattcacttttacttttctcttagatgtagaaacctttttgatggtctgctttttcggaactgcataaatagtaactattctacttgcctgtttataatctgctgttgcaccggctgttatcttaatcgttacttttcctggcttctttacaacaagttttttgccctgcttttcaacagaaacaacattcgtattatttgaagtaaatgttaaacttccaactgcttttacttcgttcttaagattaaacttcgttccataaggaatcgtataggatgcttttttcacagtaattgcctgtttttttatatccttattataaactacagataccttagatatcttatcatttgttcctaaaattttaatcgtatctttttctttcgtatatcctttaatatccggtaatatataagtcatactctttcctgaaacaacttttactaccctgtattcaagtacattattttccttatcacataatgcaataaccactctggaatatttttcgttggatgacactgcatctttatagaagcgaagagaatctaatgggtatcctttatcgtcaaaaagcgtttgattatcccatgaatttcctccccaaacaggatttccattataatacaacttactcgttggataatatccttctgcattttctgccgcccatcctgttccgaattcatttgccatttctttattatatttccaatttacccaaccagctcttacaggaatccatgcgccttcccaataaaaagcacctagtccattatcatttgataaaattgcattatataaatccgacaacatatctgcctgtccctgaggaccaactttataaactgcaccattagtattattaaccatatttacagtaccatctgcatctttctgagagttaagccatgatgtttccaatactgcaaatagtttgcctcttgatgcaacatattctccagcttttcgaacatttttaagcatattttttccagcccaaaaagcataactagacgctcctaaaacatcataatctacgttatctctttcccatgcattcatggcatctttatacattcctaagttaaggttatctaaatgtatcgcaaccaacgcatctggagtacattctcttactgctcttgcccctgcgctcaaataactatcaataattgtagatttttcttcttcctgccatacattagccttggttttatgcataattcccatcataccctgagatatctcatttccaacttgtaccataccaatgtcagcaccagcatctttaaattgttctaaggtttctttagtaaattcatatacattagaacacattttttcctggttatttctgtcttttttccatgcttttggaagcaactgtactgctggatctgcccaaaaatcagaataatggaatcccaataaaactttaatattatatttggctgcctctttcgctatttctaacccagccttaacatcattggatccaccaccataagtctctcctttttcattatacggatcattccatatacgaatacgaatgtaatttacaccattatcacttaaaacttttagtaatgaggcttcttttccttcattatcataatattttaccccagccttttttaaggcagtatacgatgaaatatctatgcctcgaatagtagaatctgacatattctgtacttttttaatggttactttctgctgttttaaaccagtatcatctccgtatttataaggatctctgcttgtatctgtctcatgaccctgtgcatatgcaaaaatagccatggaaacctgtgcatctccttcatcatcaaagaaagacttccagcttccagcatatgcagcttcattataaatcaaaccaccagcattcttctcatcaattgtggcttctaacaagttataaatgctgtcagcctgtgtatatacattggctgtattcgcctcatttacacgttcatattctacgttagaaactatcagttgtttatccgatgcacaactttctacttctttttttaaacttttaatataattgtttgtattattatctggataaacatttactccaatataatcataatctacggacgcatatcccaatttctgaacaatatattttacagaagcggcatcagatggcgcagctatgctgacagcattctttacaccttcttttttcagcaatgctgaaatatcgcccattgctttccagccttcccagccttctccgtcagtaattccaaggaaattccaatccacttcattaccaatcgttacaatatcaggaaggacattcacctgctttaactttgcaattatctcttttgtatatgtttttgcactttccactcgacttaccgattgctctgctttctctgccttctcccagtctgccggaagcttctgtccattctcacccgcataagtcatttcgtctgaataaagtaagacaagatttgtcttaagatttgctttagatgcttttacagcttttaatgtttttattgcattatccaaagaaagatatgcattttcccctgttggatttacagcaacttttaaagatatggtattgataccctgactttttacatagtcgaaaatattgtctacggactgactcatataatttttatatgatttcccccactccagacactgctgataataagtaaaatccgctcctaaaatagtattcgctccaattccagaaatctttttgtactttttaaaagcatccttacttatttctggaatttcaatcttatctgctgacgaacttacttcttgcgccttaaccggatgtgtatccaaactaaatccagttgttgcaaataacatggttgccattgctattgctacacatcttttgatagccccgctaaatttttcaagattcttcattttcattagtagattatgattgtttttcataagtttctcctttcttataaataataatatatattttaacatattataatctcttttcaagcatacactatactaaaattagtaaatttttgatttttttcaaacatactctatttttttatcaaatctttccctcgctttccgaactcatgttgaaaagatttggaaattccccgaaaggttgtgattttatgtaaattctgattttactccagcaactataaacagccctcagagaatgaaataatctatatttgtggcctcggagcaaaggttggatgcgagcgctttaagcgaacattcaacctgaagcgactaaagtcacaaatatagattattttggtgtgcatcccgtcaagtagacaattaaaaaaatataaaatttttgtgttgcccggtcggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgccttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcgttaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagccttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatgggaatgttttatgcaatattgaacgatctcgacacgttcttcaaatgtagtttttctgcctttagtcatgattggtctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccatttcattctctgagggcgtccgttttgccagataaatcagaaattctaggctcttccgaattccgagagtacaagtccttcatttctctccagagtcattcccacactccagctattgataaacagtaacaatggacgacctttcaaatccttaatcttcttcatatccgatgttccacgaagattttcaaggtcaatctctgtattttcaatccagcggatatattcatatggaagtttttcaaggcggatttctacattgtattcatgttgcaggcggtaatttaatacatcaaactgcaatgttcctactacacctacgattacttcttccattccagtattaaattcctggaaaatctggatagcaccttcctgtgcgatttcgttgattcccttgatgaactgtttacgtttcatcgtatttacctgacgcactcttgcgaaatgttctggcgcaaaggtagggattccttcgtaagcaaatttctttggtgaagttgtgatggtatctccgatagagaaaatgcctgggtcaaagattccgataatgtctccggcgtaggctttatcaatcatctttctctcacttgccatcatctgctgtggctgagaaagacgtacctttttgtctccctgtacatggaaagcatccattcccgcctcaaattcgccggaacagattctcataaaggcgattcggtcacggtgagctttgttcatatttgcctgaatcttaaatacaaatgcagaaaaatctttttcctcaattgggtcgattgttccctgatcagaagttcttggcagtggggaggaagtcattttcaggaagtaatttaagaaattctctacgccaaaattcatgagggcagaaccaaagaatactggagagagttctccggcatcaactaattcctgatcaaattctgcactggccccatctaaaagctcaatttcttcctctaatacttctcttgcttcgtctgtgacatagttgctgatttccgggtcatcaagggcgatttctttcatcgttcccatctttgtacctttcatcgtatcctcaaataagtcgattttctggttttttctgtcgtaaacgcctgcgaactgtttaccggaaccgattggccagtttaccggacaagttgggattccaagttctttttcgatttcatctaaaagatcaaaaatatcccttgcctcacggtccattttattgataaatgtaaatactggaatatgacgcatggcacaaactttaaaaagctttcttgtctgtgcctccacacctttcgatgcatcaattaccataacagcggaatcggctgccattaatgtacgatacgtatcttcagagaaatcctgatgtcctggtgtatccaaaatattgatgcagcatccgccatactcaaactgtaatacggaagaagttacggaaatacctctttctttctcaatatccatccagtcagataccgcatgttttgcggttgcttttcctttaacggaaccagcctggttgattgcacctccatataaaaggaacttctctgttaatgtagtcttaccggcatccgggtgcgaaataattgcaaaggtacgtcgttttttaatttcatctattctgctcatttttctctccttgttttttatgctcctatacgataacttttattatcctgaagcattccgcaattgaattactcggaagccccatttaatttcccaattatctattttcaatctctctttactctatgttgcctgatttttctatttcaggtcaaacagtacctattatcgtataaaaccatcattttcgcaagtatatcttttatttttgttacatatttcagattacatccttctacgtcccgtaatttttctattttaagcaaaaaaagcgagtatcaatacccgctttaaaatcaagctgctctatcaaattccttcatatactttatcacaacaaatatgcataacaatgccgccactactgctatcatgccaccagcaattccgatataggaaatggacagatgggtacaaatacttcctccaatccatgtcccgcttccgattccaagattatagattccggaatagattgccattgctacagaggaagccgctgccggtgcataagtaataatttctgattgaaatgtcacgttaaatgccataactgccataccccagaatgcacataataaaacaaccgccatatgtgcttttgatatcggatataataaaagtaatgctgccgccacactgatcattaccagttttacgaaaagatatttattcttgtcataataatgggaaaataaaaaacttcccaaaagacctgctgcaccaaatatagtaagtgttgttgtaacccagttagcagaaagaccagccaccttctgtaagaatggttcaatataactatatcccgtataatacgatgtggcaaataaaaaggtaacaagaaaaattcccatcagcgttttatttttaaagatttccggcatctgttttatggagaaagactctccgcccggcactttcgggaatacaaaaatcaggtaagcggttgtgataaaagcaatgattcctacacagaaaaatgccatattccagcccatatgaagtccgataattcttcctagcggaagtccaagaatcatcgcaattgaggttccggttactaccatactaagtgcaagtgaacgaaacttttctgacacaacactgactgctgccggtgatgcgatcgaccagaatactgaatgtgtacacgctacgccaatacgtgatatcattaacattccatatgaagcagaaaaagcggacagcatctggaagattccaaaaagtgcaatcgttcctaacaaaagtcttttaaaatcaatcttattcaatagaagcatcaacggcagagacagtaacataacgatccatgaatatactgtaatcagtacccccgcatgtgcctctgtaatatgaaagctgtcggcaatatctgtcaacaaaccaatcggcataaactctgatgtgttaaatatgaatgctgagactgtgataccaagcagtggcagccattctttaagtgtcattttactttgcataataattcctttctaaatagtaatttgccgcagccaaagacagtcttctgaaagataaataaagcatatttgtggcctcggaacaaggtttgaacattcgcgcgtccaagcgaacattcaaaccacagcgactaaagtcacaaatatgctttatttatctttcagaggacatctccccttgcctgtagtaaatattatttattctgcagagcctttgttaccaaagcagcgatttcatccaccttccacgctggctgtgtagatgcagaaatcttattgcctctctcccagattccctgagcagatgcagattcttttggtttatactcttcgctgtcatctttccatgctggctgtgtggaactggatactgttgttggctttggcagtggtttgttatagaactcaaggttctctgttaattctttctttaccagagctgtgattgcatcaagattccatactttctttgtctcagcagaaagtccacctggtgtatctgtcacatcccatgcgccctgtgtacctgctgccggtttacgaggagcttcgtcttcgtctttcttccatgctggctgtgtagaactggaaattgttgttggtgcaggaattggcttattagaaaatgcaacttttacgttgctggcttctaatgcctttgttacaagtgctgcgatttcctgtacattccatttctcctttgctaaagaagaaacaccgcccggtgtatttgtgctgtcccatgctccctgtgttgctgcagatgctttcggagccatgtcttttgaccaggatgctgaagttgctgtagaagcttttgttggctttggacgtgcaacattagaaaatgctaactggttctctttgagaatctccattacctggctatgaatcagctcctgtctcttgttatctatcatgtctttctacccctttcccaatatgtatactttggttttctggttatggtgacatcctccccacctatagaggtcggttctcgttcgatagcaccgttgtgctaagcataagcgagctacccccgtgttgtcccacggttgtgttatgttatataaactgcggctattcaaagcaaaaaataagcatcgcaaatacgattccatgaattatttctgaatagtcatatttattttattatagcactaatctaaagaaaggatatatgaaaattgctgtcttattactgaaatatattgactctttgagagctgttttgggctgcccatgagtacatgatatttttatcagcgacaaacatattatagaagcaactatatacttcctgatctgccgcaggcaaagagacgctctcagtaaataaaacaacctatattttgactttgtgttgcagaattttgcccaataattcttctacagtggcgtctaccttgcctgtggcaaatcagaatatattatcgcatgattccccacaattttcttactttcatacattgccgcatccgcctcatgatatagcgtatcaaaagttgctccatctttatccgaacataaagaagctcccagactcacattaattttctctccctgcatttctggtatggaaatcttatctatttgcgtaaataaacgtttgaaaaatgattccgcttgtgctttatctggcattcctggaagatacatcgcaaattcatcacctccaagccgcatgacaatatcattctcacggcaggctcgctgaaggactgctgcaagcttaatgagaacggtatctccaacagcatgtccatatgtgtcattgatttttttgaatttatcacagtctaaaaggcagaacaggccacctttctttttttcaaggaattctgcaatctttcgctccccgcttccacggttattaataccggtcatggaatctgtttcagaaagatacagtagctttttctcccggcgtttctgttcgtcaatcacttccacacagtaaagaacatgccacagacggcctttttcatcgctatctactttgataaagcgctcgcggcaccatccggaaactgtacctataaattcatgaacgattgtgtttgtttccattaatcgtctgtctaatgttgataagtccacaaactccagtacacttgataaatacatttctgtacagaagtatttcatagttgtatatactctttttgaaaaattctcctgatcaagctcttcacattctttttctacatgttttacattttttatctgctcatactttcctgtttttatatcaattaaatgcatacataaataaatctcagaaagtgctgagtagctgctcatacttgcgttatattgctctttttgaaatgtatttcttatttttaaaagagaaatcagcatggttccgatcatatctaaaaacattgttaatgcattgtaatctacagccggtggattatctacaccgaaaaatccctttatctgccctttatggcgtaatgggctgacaactactttacaaacattctggtacttaagcatattgtaagatacctgatgtactccttttaattcttcaacatcagaaataataacactttttccctcatcaaaagtatcataccaccaatcaattacttccatattcacaccctgcaaatgctcaatctgcggagtaattccttctgcacaccattcataagtattatttgttacatgatgctcctcgtcatcctcaaaaatataaattctgtcagatccgatatgttttccaaaaaaactgataaattcattaatttgtccctcgggagtatcgtattcaagtgctgaacgcagtgcctcattaataattgtttcgtatttcttgattgacttcatatattccgcccctcccatgatacttttgtaaatattttttcttgatctacatatatcttttcttaggtatgcctgccagaaaatcttttaagaatattcttgttcaattcctctgttttatcataagatgtgtctatagcaattaaaaatactactataattaaaaagacaaaaaacaatatatcctatcatagtttctggataatttttcattcttatcttattttctctataaaggtcctaataatatagtataaaaaactatttacctaaagtatatttaaaaaatgctttccagtcttttttaatgcagacactctctatattatagcaaatatagcaaaattattcatctactcttttcaaagcacaaacactctccacatgaaccgagtggctgaactgatctaccacggataccttctccaaggtatatttttcctcacacagtatctttaaatctcttgctaatgttgccgggtcgcagcttacatagacaatgcgcttcggtgccatatcgagcattgtgtttaagagtatcgcatcacagccctttcttggtggatcaacaacgatgacatctggatgaatcccagtcttttcatactgtgcaggtacgacttcttctgcctttccaacgaaaaattcaacattatccatatgatttaatgcggcatttctccttgcatcatcaatggcttctttaatgatttctacaccgtaaacctgctttgctttctgcgccaaaaagagggaaatagttccgattccgcagtataaatcccacacaagttcctgccctttcagctcagcgtactctaatgctttagaataaagaacctttgtctgctgtgggtttacctgatagaaagaaagcggcccaatctggtatttaatattaccgatataatcttcaatataatcctggccccatacagtctcacagcgaagtcccaaaattttatttgtcttatcagtattcgtgtttacgataatacttgtcattccctcgattgtttttaagtcatctacaagtttatcaatatgtttcaactgctttttcgtaccatttacaataagacataccataatctcgccagtagtaaatcctatgcgggttaaaatatggcgcaccaaaccactgtgatttttctcatcatatgcagaaatcttattttctttcatataagtaagaactttttcaacaatcgggtgggttacttctgcctgaatcgcacaatttgtattggccacgatggagtgggtacggcccgcataaaatccggcaacaaggttcccctctttgtcataaccgacaggaaactgtgccttattgcggtaatgccacggttcttccattccgtatactggctctatcttctgctcaatatcttcttttccaaaaccgccgatacgcatcaggcagccttccacaagactctttttaaaagaaagctgtttctcataagaaatctgctgtaacttacaacctccacactgtcttgcgaccggacatggcggggttactctgtcttttgatggtgttacaatttctaccagacgggcataaccgtaattcttttttaattttgttatggaaactctcacttcatcaccgattaccgtgtctttaacaaagaaagggaagccctggtacttgccaagaccttccccttcctttgtaaaatcttcgattgtaagtgaaatttcctgattctttttcaaattcaacttctgttctgatttcactttattattcaatccttttctcctaaatgacttgtcgctctgatattgctttcaaataatttattgtaacctttccactcaccgctctgacgactctcttctgcaagtgcttcaataaacgtctccatctttgcatcagtattatctgcaaaattaagagctaatgcctcaattaatgccggcttcttaggggaaccgtattctaactcaccgtgatgtgctaagatacagtgctttaattcattcgccagcttcgctgggaaaccattaatatttctaatcttctcatcaatcatcatcgttcccattacgatatggccgaccagctgtccgacatctgtataatcgttctccgggaaatcagaaagctcatcaatctttccgatatcatgacagattgctgctgtaataagtaaatctttattcaaaaccggatactgcgtacaataaaaatcacacagtttcgttacgcttaatgtatgctctaaaagaccgcccataaatccatgatgtactcttttcgctgcggaatgtgccttgaacttggctgcaaattccttatctccaaagaaagcaactaatagctgtcttaaataaatgttctgtacatgattcacataagaagataattccttaaacattccgtcaatactcttgctggaacatgggatataatcctccattgcaaattcgccctctctggctttacgcagtcttctgacattgagctgcggactgccctgaaagcttgtgacattaccctctacacggatgtaatccatctgttcaaaattctcgattccattattcaaatcccagatttttgtgtcaatgacaccagtcttatcctgcaaaatcatggaataataagtctttcccgcttttgtcttcgcaatattttttactttacaaaggtacacttcagagacattatctccttctctgagttcattaatataacgcatatacgtttcctttctaatccatctctttaattacttcacatattatagcttaaatttaataggctgacaaccaagaaaatgctctatttcgcagatttttccgcatttttaaaggctttacgccccgtcttcattgacaaatgaagtatttcatgtcacaattacttttgcattaaattaaggaaaggaatagtccggcacagtatcggactgtaggtaagcattatgattagaaaacacattattgcacacggccgcgtacagggcgttggtcttcgctttacagtaaccggttttgcaaaaaagtacaatgtgacgggttgggtccgcaatctctatgatggtacggtagagatggaagtccagggactagaccaccgtgtggaactctttttacaggagttatcctctgatcggccaggtgggaatcgcttcatccgcattgacaaattggacattacaaatattccttctgtaaatgtagcagatgaaaagggctttcgggctcgctactaacaagttaatctaatattatcaatatatgaaaatcttattcaatcataacttacgcagtaaaactatgtacaaactatatactatctggattatttctctttacatagctctgcaatacgttttcctgcatactgcatccatcacaaattaagatgcatatcaagattgaacttaaatttttgagaggattttatttatgaatacaaaggcactaatcacattagaatatgataaaatcattaaaaagctggagacttttgcttcttcgaccatgggaaaggcactctgtaaagacctgcttccctcctctgattacgaagaaatcttgtcagcacagacagaaacaaaagatgcactgacccggctttataagacgggttatctttcttttcagggactttctgatatccgtccacatttaagattattagaaattgattccacattaaatacaaaggagcttctcgatattgcccgtcttctttctattacagcacaggctgtagaatacggcgatacggaagatgacataatggcatatgactccttaaacagctattttggagaacttgattcattagaattcctttaccagagaattacacagtgtattttatctgaggatgagatcagtgatgatgcctcttccgcattaaaagacattcgccgcgaaatcaaacagacaaatatttccatccacaataagctgacttctgttatcaactcacaaaataacaagacaatgcttcaggatgcgctgattaccgtccgtaatggccgttactgtgttcctgtaaaaacagaatatcgtaacgcctttccgggtatgattcacgatcagtcttcttccggttctacacttttcatcgagccgatggccgttgtccagttaaacaaccatttgaaagaattagatattaaagaaaaaatggaaatcgaaaagattctccagtctttaagcgcacaggccgcttcctgcagccgtgaattagaggaaaatcagaagattctgacaaagcttgatttcattttcgcaaaggcaaaatatgcaaaagaatatcagggaaccgaaccgattttcaatacagacggaattgtagatatcaagcagggccgtcatccattacttgatccgaaaaaagtcgttccaatccatatttatattggcgaggactttaatatgcttctgctcaccggaccaaatactggtggtaagaccgtttccttaaaaacagtcggtctcttccagcttatgggacaggcaggactccacattcctgcatttcagggttcccgccttgctgtattttctgatatttttgcagatatcggagatgagcagagtattgagatgaacttatccacattttcatctcatatgacgaaccttgtccacattttagacgaagctgaccccaattctctcgttttactcgatgagttatgtggaggaactgacccgacagaaggtgcggcgcttgccattgccatcttagatgacctgcatacaggaaagattcgtacagttgcaacaacacattacgctgagctaaaaatgtacgcaatggacacacctggcgtagagaatgcctgctgtgaattcgaccttgagactctttctccaacttaccgccttttaatcggtattcctggaaaaagtaatgccttctccatcagtgaacgtcttggcctgccagactacattatcgaacaggcacgctcccagattgatgcgactgccattgactttgaaaacatgctctctgaattagagaaaaacaaagctgaaattgaaaaagaacagtctgaactttacaagacaaaacaggaaatcgagaacttaaagaacagcctgaaagaaaaacaggatgacattaaagaaaaacgagacaagatgctccgtgatgcccgcgaggaagcacgaaacattctcgaagaagccaaggaagttgctgatgaatccattcgtaaatatcacgcatggggacagcatccaaagcagaacaacatgaaaaaaatggaagcacagagaagtgatctccgaggccgcatgagtaagcttgacaaaaagctcgcctataaggcaaagaagtcttccactatctccgatccttctgacttcaaagtaggcgattctgtatttgtaactacactttctctaaatggaactgtaaaagaagctgccaacaaggatggagaccttgtaatccagatgggcttcttaagttctgtagtaaactacaaaaacttagaacttctcgctccagaaaaagcaccgaaaccacagcatcagccaaaagaccgctacagtatcaataaggccgcaacaatcaatccagaaatcaaccttctcggaaatactgtggatgaggcaatcgcccgccttgaaaaatacctcgatgatgctatgatcgccggacttacttctgtccgggttgttcatggaaagggaactggcgccttacgaaagggaatccacgagtatctccgtaaactgaagtttgtgaagtcctataagcttgcagaattcggcgaaggggatgccggggtaacaatcgtaacttttaagtaaatactaatttgccggggacataaacgccgctttagcagaagatattgagctaaattgtatggagtcttctaaagaaaaaagaatgatatgcttcaataattgcatctactacgtctatctttttttctaaagccacttgttttatcaagtgcttatatgcttttccgatatcccaataggaaggaactgcatactgacattcccccacattatcaaaatttccaattctgattttgtaccagcatccacagtcagccagcaaagagagcctatcccctatatttgtggcctcggagcaaggtttggatacgagcgtgtgtaagcgagtattcaaaccgccgcgactaaagtcacaaatataggggataggctctctttgctggcgtctgttccgctctacaaattagtatttaccattcgtatttgtggagctgtccttcgagttccagttctttgaatccctgctgtcttaatgcctcatacaagacgattgctacagaatttccaagattcagtgaacggatatgctcgagcatcgggatacggactgctgtctctttatgttcaagaagaatttcttccgggattccggcgctttcttttccaaacatgatgtagcagccgtcttcgtattctacatctgtgtaagtttgttttgactttgtggttgccatatagatttttgctcctggattctttgcaaggaagtcctcgaagttcacataagtacggacatctaatttatcccagtagtcaagtccggcacgtttgagcattttgtcgttgattttgaagccgagtggctcgattaaatgaagaatgcttcctgttgctacgcaggttcttccgatatttccagtgttggccggcatttccggctcatgtaatacgatgtttaccataatttattcctcgatatttcttatttactactattacagatttttctctttacgtaatctttccacaaagttagccagacgacctaatgcctcttttaattcttcgatagaataagcataggatacccgaaggaatccttctccgcagtctccaaatgctgttcccggaatgatggctactttttcttcgcgtaagaagcggtttgcaaattcatcggaggtcatgccaaattctttgatgcatgggaatatgtaaaatgcgccttctggctcgaaacatttcaatcccatttcggagaagagttctaaaacaaatcgacggcgctgattatatgcatttcgcataatctgaacgtcttcctccccgtttgtcattgcttcgattgctgcgtactggcttgttgtcggtgctgccataatcgcaaactgatgaatctttaatatttgctgcatgataagttccggacccgtggcaaatcccattctccatccggtcatggcaaaggatttactgaatccattgatgataatcgttctgtctctcattcccggaagagaagcgatagaacagtgatcctgtccataagtaagttctgcataaatttcatcagaaatgacatacagatctttttcttttacgatttcggcgatcggctctaagtcttcacgggtcataatcgcacctgtcggattgtttggataggataaaatcagaatctttgtcttatcggtaattactgcaagtaattcttctggctttaacttaaagtgattctcttcttttaagtcaattgttacaggcacaccgtccgctaacttcacgcatgggagataagagacgaaagctggctctggcaaaataacttcgtctcccggattcagcatcgcacgaagagcaagatcaattccctcacttccaccgacagtcacaacgatttcgtgggcaggattgtaagtaagttcatatttacgatacatgtagtgtgcgattgcttttcgaagttctaataatccggcattggatgtatagaaagtacgtcctttttctaaggaatagataccttcctcacggatatgccacggagtatcaaagtccggctcacctacaccaagggaaatagcatctggcatttcctgtactaaatcaaaaaatttacggattcctgaaggtttcatctgtactactttatcggataaaggatttctcatggtgtcaccttcattctgtttgccggctctttatctataagaatcataccgtgatctttatattttttcaggacaaaatgtgttgctgttccggcaactgcttctaatgtggaaagctttgtggagacaaacatggagacttcttttaaagttttaccttctaaaaagatagcaaaatcaaaagctccagacatcagataaatggactttacttccgggtagtttgtgattctctctgccagcttttcaaatccctgtcctctctgtggggtaacacgcacttcgataaatgcagttactttctctgtgtctgttttatcccagttaataagagtaggatatccgcagataattccctcattctccattttttcgatttcttctaatacaacactttcgtctgttccgagcatgatagccagatcgtgcaggtcgattctgctgttattttccagcattcttaaaatttcgtgacgcattgttctctcctttatatattttcttttcatttatactaccgctgttttatattgtcggtcttatatttaaaaataaaaaactgatatctagattatttataacttccagaaacataaatccatctgatgcttgtattatttacaaatttcagaaatatctacctgaactttataatattcgtccattttcggtggttccagaaaacgtgcttcatcatcataacgaatcagtcggtcattcccagaagtcgtctgtccgattactgccgctgctactcctgccttctggagctgctctacaattctcgctccatttgcacaggcaagaagcaatgttccgccggaccgaagcatatatggatttaaattaaaatattcgcatacttctatcgtatgctgcttgatcggtatatttttaagatcaatagacagcccgacattggctgccgctgccatttcccagagtgcggcaaaaataccgccttcccgcacatcatgtacagaaacaacttctttttcctgtaaaatatcctctactgccgtcatagagccatcatcaaataaatgctttgccgcctcaacataggacggtgcgtatctttcttctaatcgtttcgcatactcggccgcaagcatagccgcaccttctctgccgaccgttcctgcaacaactaaatctaaatccgcattccccacagctatctgctttgtgtttcccttactatccgctatgctctccttgcttactagaatgctctccttatttctcgtgatgctccccttgtttgctgtaatgtctttcctattttctgtagtacttcccattgcagtaaccgataaaataagtgtgctgacatacggtgacaccgctgtatgcccggaaagcactaaaatattttcctgcatacaaaggctgtcgatttcttttatcaatgcctttaactgtttttcctctgcttcttccggcataagaatactgagcgaaatcgcttttggagctgcccccgctgccagcatactatttactgcaccgtagactgctctttttgctgcaaatgtccagccttccaccggatttactgccattgccacaccgttttttcccgaaaatccctgtgtaaactctggcataaattccggcataaaaagaactccggcatcctcaccgggtgccggagagcctttttcactgtggttatgcaactgtcttagtaccgagcgttttaaaatactctcttttacctttcctatccgcataatatacactcccacagcggaagcaggctcaccgcctactccgccttatttgctccctgattattatttcctgtcgtacctttgctgccttctgccttctcaccagcttttgctgtctcatctttcttctgcgtcgttggctttggcacttcctttttctttgttccgacacggacaacggatggagtggacatataagaactggaattcacctgcgttctcttcgtctcttttccatctatgtatacaaccttccacagtcttgctgtgtaaccagtacgtccattggattctacaactcgcttgccctcttccatcgtgttatccttgattactttttcggaaggacctcttgtagaaacagtctctgatacatactctacctttcggtttgaagcacgatattccttaccgtaaatagtaaatgtaatgctgcttcctccagctaccccctgaatatatactggatgatcaagattattggtaaacttcagatccttatctgttccggaaatcgccgcatccgcagataatggaacataatgtaccgtcattgaatgattcgatcgctctgttacatttaactctgctcttaaaaccgcattgtaaagtgttgtagatacctggcagattcctccaccataagtctgcactgtctgtccattcgaataagaacccgcaagatggtatccattatccgctgtaaatggtgctacttttgaataaacagagaaagaatctcccggatacagtaaagttccattaatcaggcttgctccattctctacattagcgcatcttccagaagcagagcctgcataagatgttgtaaatgtcccaagcacatctttaatcgctgaaagctccttcttcgtatgctttgctttatctaatgtataatccatcggaaatacaacagacttgtgatcccagtcttttttgctaaagacttctgtaagcttgtctgcatttgcctcaaagtcgatatctacaccatctacctgctttgtgataacaaactttccgtcttttcttgtaatagtggcatcctttttctttgcaaggaacttcttcgccttcttcttaacaaccttcctcgtctctgccttatctacagaaaaggtaagtggaaaatccattccttccttttcaagctttcttacttcaatgacacgcttaaagacattccctgtctttccgaaatcatatgctttctctaccacatccatatttgtacatttcagaccaatatcggaaagagcaaatgtactctctttctttttcacctgcaatgtaaccgtttcctgcgataccttatctatatattcctgtacttttgcctttgcctcttcctgtgtcattccgccgacagacatcccctgaattgtcattcccggatagattgcgtcaatattaatatatttggaataataataataaaacgccgccccgccgcctgctaaaataagaagaagcaatacaagtatgataatccctactctttttttcatattgcacccttttactttcttaaaattctattaaataaaacatcattctaccctatagatcatgatttatttaattcatttctctcattcatattcaaaaactctgatgtgtttttgaatcctacatcatcattgctggaacgactgttgtgataaccatcgcgataactactaatacaactacaactgtagcaattctctgtcttttctttgtgccatctgacttcatactaaaacttcctttctaaaataaactatataaaatgcgtccgtcttcattttctaacttcatatagtgatttcgcatctttcaaagatacagcacttcagaacagaaatcactatatctctcactctgaccttgctatggcgcttgcttgaaaaatacttttattgttataaacatacagactttttttgttctcctgaacattcttttttattttaagtcatttccgtcgtacattcaagtctctattttatcaggatttactatcctatatcattatcaacaacatcgtaacctgctgttcacttattataatatttcccactctacagttctagccgcccgatttagcggattccttctgctataatcaaataagcaaaacacctgttttttctccacctgcccactctgctcaaacttctttatattaatttcaaatacttcgatatgactttggttggctgccctctttgaatcataaattcctgcctgcacatcttctggaaaaagtttttctccctgttctctgtataatgctttccactctttcttgtattgtgcggtatcttttgcccacgcaggtcttccttttacattttctcgaagatacatatcatatagcataatctcatctaaagtatccctttcattttcatctatatgttctcttaaaaactcccgaagaatattatacttttcgaatcggttgtgattcagcttatgatagccttttccccggtaccatgctgaaaacatttcatagaagcggaatggactctcaaaaaatggaacagcatattttaaagttaatgtatactgaccactgttgtaatagagttctacaagctcctccacaccttttaataaaataatctcgtcataagagagccattttgttccaagtacttcgtatggcggctgattacgatatagaatgctgtactttttgacttcttcctccatcatcgttccctttaacactttaaggaatccaagctgaagctggtctggctcatgtgcatataaatcatcaaatgagcatccaaatctctcataattctcatatggcagcccggcaattaaatccaaatgctgatgaatatttcccagttcatgtactctgtccacataatgaaaaagcttatctaaatccatatgccgatgaatcgcatcaaccgtctccccatttgtggactgcactccaatttcaagctgaatcagacccggacgcatctttgcaaaaagctctaactcctcctcaccaagcaaatccgatgaaatctcaaaatgaaaattcgtaattccgttatcatgttccaccagataactccagatatcaatcgccctctgcctgttgcagttaaatgtcctgtcaacaaacttaacctgtggaacttttgcttcaagaaaagcatccagctcttttttcacaatcggcaaagaacggaatcttaccgtcttatccacagaagaaaggcagtaactacaacagaacggacatcctctgctcgtctcataatataaaatcttatgttcaaaaagatgaaaatcttcgtacacaaatggaatcgtatccatatccatcaatgtggcaaaacctgtattgatgattttcgttttatttcctatattgctctcagcatttcctaaagctgcttctcctaaaaaatcccggactgcaattccctgtaacttttggagctttgacatatctatataattcgttggatagacattatcttctcctgcgaaatgtttatcttctatatctttttcctcttttacagcttgtttcctttctatgaaatatctcttttccacaattcctgataagacttttttactttctgattgtttgtatacatctttaatccgacatttttcctccactgttaagcaaatcagttcagagaaaacttcctctccctctccctgcataatcaggtcaaatgctggattctccatcaaaaatttattcgctgcataagaaacttccggacctccagcccagattttcacttccggacttactttcttaagctctgccgccagctccctcacaaaagaaatattccatatataacaggaaaaaataatgatatctgcctttgcctcatataaatcctgtaaaatgtcctccacataattattaatcgtatattcttttaaaataatctccgctcccggaatcttttttctgtccgcatacgccttcaggctgaagattgccagattcgagtggatgtatttggcattaattccacataataaaaagcgcattacatactccttccaacaaaaataaatcctgccaggcagattcttttattcaatatgggattcaaatagaacttcccggctctgtttgaataaaaaacctacggaaatgtactccgcaggctgcttttaattcgaacgttttcagtataacatgagatgagcgtttttaataggggaatgttgtttaaatggctaagctgacgcatccttatcctttgtaatatacaaattgcttcgtatcactgcgtccattcttaaacctcctaactacaaactcccaatctggcaagtctgttaaaaacttagaaaagtgaattaatgaactttcgttttctataaagctataatcttctgaacaatttcaaaaaaccccttgcattttcaaaaaaactgtgctaaaataaatttcgttgtgagacagtacatcacatgcgggtgtagttcaatggtagaacactagccttccaagctagatacgtgggttcgattcccatcacccgcttttattttttcaaagttgttaaaacatttcaaaaagttcttgacaattagaaaatatatgatataataaatacagttgaataattcatttaagttttatgcacgagtggctcagtggtggagtatcgccttgccaaggcgagggtcgcgggttcgaatcccgtctcgtgctttttttgttgtctttttacttaactaatttatactagagcgtgtttgaaaaataaaagttgcacaaaacatatattcccacgccctttttcatgataaaataaagaaaaaaggggagtttattatgttgagacgatatgaattaacagatgaagaatggaatcaaattgtttctctactgccacctgaaaattctggcaaacaaggacgaccatccaagtgtaaccgtaccattcttaacggaattgtctggattgcccgcagtggagcaccttggcgtgaccttccagaacgctatggcccttggcaaactgtctattctcgctttcgcaagtggatggaagacggtatccttgataatatctttcgtgttttaagccttgatgcagaattaagcgaattatcaatagatgcctccattgtccaggctcatcaacatagtgcaggtgcaaaaaaagggggccatccaacgaaatcggacacagtcgcggtggagcaagtacaaaaatccatgccattgtagatgcttatggttatcctgtttatgttatgctcagtgagggacagcgtaatgatattaattacgccatccctttgctagaacaagttgacataaaggaaagtgatatactggctgaccgcggatatgatagcaataaattaatggactatatctatgcccatggtggtgagccaaccataccttccagaaaaggggctaaatttgaccgttactgtgactggcatctttacaaagaaagacatttagtggaaaactattttctcaagttaaaagcattccgtcgaatagccacgcgttatgataaattagcatccacttttgcagcatttatatgcatcgcctcaatattaatttggttaaaatgaacaacttaaaatgtttttcaaacacgctctagaattaaatttggagatgttgcattataataacatactgcaacatctccgtttttttacttactggtaattagctatcttgtaaacgaaatgataaatttttaatccatacaaaataagaacttgccaacaggatacttgataagaaccacgttataccaaagaaactatatttaacatttgaccatagaatatacgcagcaaacaatactattgcaatataaaacaaaatacttacaatcttccatagcagcgaatcatcagaagaataacaaatttttcttatatcaacatattcattagtttgataaatcaaggtgatgatgatcaatacgatagaactaataatttttataatagctgctccataattccacattataggaaagatcaacaacaccattgtattactaactttagaaccatccgccgtatccatcataatttttacatattcataagatagtaagtaattaagccatgttaaaaataaaataaatactaaaaatatcttctttttcattgcctcgctcctttaatctggatgtattatttaacatcttctattgattgcgttgaagcttctttggcagcttcctgttgatcttcttcacctgctttatcataccatttttgtgcttcttctccttctaacgtagtaaacgtaccatctccattaggaatatcaactcttatgacctgtcctccctggtcaacagaaacagactcatcaaccacattacttgtttctgactggtctgtaaaagtacaagcatttaatgacaaagctactgtcactgccataaccagtaatatttttttcatgatagacctcttttcgttttacttttttgctttctttaatgtagtattactttttataatacatatcttcttccacgttttcaagataaatcacttcaggttaatgattattttttccaataaaaaaagaagccagctatataaccgacttcttctagaacgtatttgaaaaatgctttctgcaagatgtgcgtcgcaatttgcgggagatttcgcctgaatgaaggcggcgtagcgggctacggcaactgaatgaaggcaaaatataccgtaaattaaggcgtgcaggttgtaggaatgatttttcatacacgctctaaactgtgtaaaaaattctctgttcaaaattgattcaatctatctcttacaatgactttctaaactcttcttcaattcctataattgtctcgattaaatcatctgcactttgatacttatatcttccaaacataattccccagtctatcatgagtgacagtacagttgcattacgtttggcatctttatcttcgattatatcaaagtctggatatggtatctcacttacggagcggaaccagtttaccatgctggcgtatcctggtacatcttccatgacttcctgcaagatgctctgtaaaagtccctgctgtccacggtacctttcttttacactcttttcccaacataaggtaaatgtcttcatatatatttcgattaatgacttaatcgttgctaacagatatgctttaaattgctttctactctgctcggacgggaagcgtttaaaacaggctgcacagtactgagaaatgaggttgccaaccagataaccgagatcgtaaccaaatggtcccatgaaagcaaattccatatcaatcactttcatcttgtctcttgatgccataatatttgatgtgtgtaaatcggcatgaatcaatccatctgcatggctcataaacttacggcggagcttataaagctctgtgcggtatctggaatctttactgaactgatctgcaaaatctgcaaagttcttccctaaagagtaatcaatgtcacaaccaaaacaatctaaaaacatctgatcttccataatctttcgaagctcagtattttcaaaatgcttttgcaatccacgatactgttcacgggacagataatattctgatgtgcaaaattccgtctttgccataaattcgccacactgacggccaagttccgggaacatcttattcttatttaactgaaaacgcactacctttaaatcagatacatcttccatcacaaagatattattttccctgtcctgaaacttaagatatggcacatattccggtgtaatcgcatagaaaatacgcatactattgtattcaagacgattgcggtatgttgcgattttctgctggcttaccctgctgatttctgttccttgcttcagcaccagagattccttcggtgtctgcaccctgtaaatgtaattcacatagccgtctccgtcctcttcctctgttccctctccaaccatactgatctgcacaggaagagaatcatcaaaatctggcatatgcgcttttaaatacggaataatattttccttcgtaatcttaatcatatacttccccaataatcttctatccgactctatatttatctgcaacaatctgcgattatcatttaattacatagacaaactttctcataattattatagcctaatattatgaacaaaaaaagcaaaatgtttgtctgtgaggtgggaaaaaatgtggcattggggacagacgaaaacctgaaaatcctcatatatcacaaatgcttcgtatcactgcgtccaaactgctcaaccgcaatttgaacttgctctaaggcacatttgtgatatatgaggattttcaggttttctgtgtattgaacattccatgtttgccacttcacaagctagatgctgtgaatattaacctcaattgctgtgactcatattattaaatttgattccttctggcattctttattgccttttttgagaaaacagaagctcgataacagataatatatataagaactgtgactttagagcaagctcttaatgcggctgagcattaagagtgcaatgacacggaacagttcttatatatattatccattatcgagcttcatcagctttttcataaacaagcaataaaaaaatgcccagaaccggaatcgaaccagtgacacgaggattttcagtcctctgctctaccaactgagctatctgggcattcattgtattgctacaacgtctaatattttactgtataaagtgctttttgtcaatatgaaatgaataaaaattcataaaaaatgcaaaatatttattctccgtattctgcaatccattctgaaacagtggaaaatatctctttattcaggctataatatgtccattttccattctttcgtgcctttactgctcctgcctgcagtaaaattctcatgtggtgtgacagtgtggactgtccaaagtccatttcgtctaaaagttcgctggcattatattccctttcacgaagtaaatcaagaatacgaagtctgttctcatcagacattgcttttaatactcttgcgtgaacgacaaactttttattcatattatgatgatgctcctttcatctatcaatttaaaatctgaacattaataataatgctctactttagagcgtgtttgaaaaatgctctagcaatgcaatctgcggcatattgcaacgccgcagataaaatatctgattatgttatgctaatgaaacaaaactctcgttaagaaatcccttttgttaaatctcccatattccttccttgttctccgttgtctgaagctcaatcttcttatcagaatctttaatcttgatttccggattctttacgattacctttgtatgtgccggaacagacttcgttacaaatgctccacctgctacgataacaccctcaccgatttctgtctctccaccaagaatactggctccagaatataccgtaacgttatctttgatcgtcggatgtctcttcttaccctttaacttctgtccacttcttgtagaaagcgcacctaaagttactccctgatataacttcacattattaccaatctctgttgtctcaccaattacaacaccagttccatggtcaataaagaaatattccccaatctttgcgccagagttaatatcgattcctgtacggctatgtgcatattccgtcataattcgaggaaggaatggcacatcctgtgtatacagctcatgagcgattctataaacaaaaatagcaaacagtcccggataagaaataacaacatcctctctgctctttgcagcagggtcgccgtcaaatccagcctgcacatcttttaaaagcatctgctgtacatatggaagcctcttaaaaaattcctcacagacttcttctgcccgctcactgatctcttcctctgtatacttttcataatctctataatacaaagaaatctcaatctgcggttttaacttaccataaatatctgtcagacggtcaccgataaaatactgtggtgaaatgagtgcaatattctcctcaccaaaatatcccggaaacattactctctttaaatcctttaaaatacgaataatacaggaacggtcaggaaggcatctctcccctcttgatacgataaaatcagttttatggcagctttccgtcatatcggcggaagcgtttaaaataatgtctttcattgtctctttcataacttaagtctcccaattttttcagaaaaagatttaatctctttctaaaatatgtattactacacttattttatttatgctaaattataccaaacaactcctagaaatacaattctaacataaaaatttcacatttgccatttctataacgatttttctttccattttccacatcgataatgaatcacatagaatatcgctctgaccacccagtcaagtaccatcgcaatccatgcgccaaatacgccaaatcccatatattttccaaaaataaaggcacaggcaatacggaacagccacatagaagttacgccgacaaccatcgtaaaacggacatcatttgcggcacgaaatacatttggcagggcaaatgcagccggccagaatatcattgccatgatactgtggagtatcataatctgcgttgcataaccgcttgtttcgggagataaattatagattttcaacataaatggtaacaagagcatcataacgatgcaggtaatccacatacaagtgtaggtgaattttaacagacgtttcgcaaagtattctgcctgtggataatctcccgcaccgacacatcggctgattactgtcacagttgcaagccccaatgccattcctggcaggatttcaaaatatgccagcgaattacttacggcattcgctgcgatagatgccgttccaaacgtggagatcaagcttaaaagaaggattttcccaagctgaaacatactattttctatgccatttggcacgccaatatgaaggatttttcgaatcattttcccgtcaaatttaaacagattcattcccttcaatgtaagtatatgcttctcatcatgtaaaagccataccatcaaaaatgcagctaccacacgggataataatgttggtatcgcaacaccttctacccctctatgaaagccaaatacgaggatagcatttccacttacgttaatcacattcataatacaggaaacatacatcgaagtttttgaatttcccattgcacgaaacagagccgctccaccgcaatacactccaagaaaaggaatcgaagctgcagatatcagcaaatatgtattacaattcgccataacatctgcctcgatcgagccaaaaactgtatgtaaaataaaatatttaccaagatagataagtaacataatggctatagacatccacaccataaactgcatcatctgtcttccggcataggcagcctttttcttatctttggcaccaagatattgtcccgaaacaacagctcctcctgttgccagtgcattaaaaatattgataagcaggatggcaattgaatcaaccagtgaaactgcggacaccgccgcttcaccaacctgcgctaccataattgaatcggaaaggccgacaaagacacttagaagctgctccagaaacaaaggcagaatcaacgctgtcaatgctttatcggaaaagagaagctcggtctttccagtccagggttttcttttgaataatgacatttttgcctcctttctttttttgttaaaacagacggaaactaaggaatatgctataccaatctgtgactttcgtcgcggcgtgttgaatgctcgcttacgcgctcgtatccaacacttgctcccaggccacagattggcatagcatattccttagtttcctgtctttgacagttcagaaggacaaagggcattcaaactgtcgtattctgcttactcaaaagttgtatttggaatatatcatcaattgaggcctacagcttaatttttaatttcccaacgccagccaaagacagccctcaaagcgagaagatatcctatatttgtggtcttagagcgaggattgaatgcgagcccttaggcgaatattcaacccgcagtgatagagtcacaaatataggatatcttctcactttgagagcgtctgttttgcttttgcctgcggcaaattcctattttagaagccgcctccagaaacatcgagtttgccatcatcatctgccgcagttccattcgaaccgcaccagttacaaactaccttatcggagccgtcataacagcttaccttaccgcagtttccgcagacaaaacatttctttgcgccgcagtaagggcagcctggatattcttcgtcagtgtagaaacttccggtaaagttgattttatcgaagccttctttttctgctgtttcttcttttaatttaaatgcccaggtacgaacccagtcattatctcttttttcaattcggattccgtaaagcttatcctgagcacattttgccagaattacgcttgcttcttttttcattctgcttcctctccttcctgataaacgaaagcaatggatatatcgtcaccgctgccttctcttgtccttttttcaaaattccgctttaaacttttttgcattttttccgtatcatgaaacatgtgagaaagcaatccatgatatttcaaaaagtcttcttcgcttgcaaatgatttgaataacccgtctgtggatacgaataatgcttttactgtttctgtggtataccagtgttcaaagaaatgaatcgcatcggtattgcagagggaagaggtgtagtttgcatgggaatttttgtcctcgagcggaatatacagttctttatctcctccgagtacaacaaatccaccatcgccaagaatcattccataggaaaaatcttttgtcaaaacggctgccagtacggtacttccgtaaatgactgcagttctaagtcttccttttgccttttccggaatcttattctcttcttcctcggtcaatggattttctaaatgatattcctctacggcctctctccatttcataagaatctgcttttccatctgtgccagaataaattcgggatgtttaaaaaactgctccttaaagtctggacggttcatataatttttcaataactttgtcgtaatctttacagcaatccttgaacctacatcgctgcggaaatgcttggcgctgccatgcccatctgccacaacagcaatcgcaaacttgtcagtgactaccgttcctgaactgtcctgacagacaataccttttctaatatggctgtctccgattactgtagaatgtactccctgaaacattctaccatccctcatcaaattcaatatccatatcgtcaaggtcagtgagatcatccagtcctaaaatgtcctgtttcatttcctgaactgcctccaccatctgctcttttttagcgcctgctacttctgcaagagaacgctcaccggtcgcatcggtaagtgtcatgctcgtgcttccgatcttagaagaagtaaccgcaatttcacgaacaagctttttcagcatttctgcaccgcatgcctgaagtaccagttcctcatcatcagtaaattcgcgaagcacatctaaatctacgttagaaccgattgccagtgcgatttttaggccatactggaaccagcggttcttcttcagcatctcgaaaccttttttatagttatcagttggataaccgtctgtcataaggaaaatgactggcgcataagagagggatggcgctcttaaaaagctgtttcttgaaagcttctggcaaagttcttcacaggcatctcccaaatctgttacgccatctgctcttaagttctcccatctctgatattcttcaatcaatactggttctggtgtaatccactcacatccagaagaaaatgacattacggcaacttttacatcggttcctgcctcgccaacaccgattaattccggtaaaatgtctcccataacacgatttaatgattcaagctttgaaccttccatactttttgaagtatctaccagaaaaaaaatgaccatacttttcttggcaggtggcattgtctctaacgggtcaattgcctctatattttcatcaaactgtctgctcatcctcatcttcctttctctcctccacctgctgcatcagacggagattccattcttcacccaattcaaatcggacagacattccattccagataggaattccctgtccattcggaatatcctttatttttccgtcaggataaaatcctctccacacgccctgacttacatttttaataccatacaagccctttttctgacgattctccacgatcagacctgtaaccgtatctttatccatcggatttcttcctgtctggcattcgtaaagtttttctccttctgcaagaagaatcctgtccattccattggtcagtgggtagtaaatctttccacactttggacaggcaaatgttccattttccttcggaagcaatcgataacaaaatccgtgaaaaccacagtgacaggacttgtagtccattgccatacgaacaaggagctgcttccagtccacctctgtcggacgaagttctctaagccttcccccatcaagaaatgccttctggaacattttctgcaaaatctccggatactcgttccagtactgaatcagcttgtcctgaatgccttttactggaatattttcttcctcacccggctccatgcagaagcgtccttctctcgcccggaaaagttctttttcctctggggaaagaaaacagcggttcaccatctttttcccttcaaatggagaacctgtgtggaagaaatattcaaataaatatactgccataaaatagcggtctgtctctaaagaatagcattctttaaaagtttcgagtgtttcctgttcttctgtttcagataataatttttcctgctcttctgctaatgcctctgccaattctggggcaagaaattctgtaaattctatttcagcggcatctggttcctgcacatatgcctctccaagaaattcttccccctcaaaatgaaacgctccatttttcaggttaaaataaaatacatctggagaaatgctacaatacaccttccctttttgatgaatctcctcaaaaaacctcgcaaactgaaatgcaccttctatcatggcattcatcgaagaaaaatatgctggccttaaaacctttttcccggtttccgcatcaatcacaagctgcctttcttcacagatctgcgcgagggaaacccagccatttttattaaaattactcattctatcctcctacctacaggagaatctttgcaatcagattatctccaaagtcaatctctaatcctttccagattggaacaccttttcccggtccaacttctctgacagagttatccgggaacttcgctttccagacatcaccggacatatttttaatgccaaataagcctttctttaaacggttttcaatgaccattcccgtaacagattcaaaatcatcactatttttctttgtcaggcatttgtataactttgcgccaagattcagtggaagttcatagtctttcacacccattgtgtaaatggtacttccacaattacggcaacgtaatgtatgttctcctgtcttttcaaatgcagaagaaaatgcggtctttccacagctacagtgaataatatccagctttagctgaatgagcatctgaatccagctcttttcgataatccgggcatttggctcctgaattccataagtaaaggaaagggtaaatgcctctctgataaagtccgggtaaatcttccacagcttgataacattatcgtgtaccccattaaccggacggtttgatgcattattcggatcataaataaataccggatcttttccataatgaatcaggtcattttcctcagtcataacgacacactgaagtaccttacttccttctaatggatccccacggaagaaaagcttaaataaaacaactgccagtgaatatctgtctgtcagcacatccggctttgcaatacctcgaacaacttccggtgccataaaacctggcataccgccaattccgaagttatcaccatctgctgctacgttatcgcaatcacaaactaacacatcgccgcttctcgtatcaataaagaaaccgccatcatttaaatcctgataactttttcctgataaatgcagggcacggaaggccttaacaatattaatggccgctgtgagcatcacatcaagagaagcgaacttcaccttaatctttctcgccggctgccccttcactctcggtttctcccagcggtatccattataaatatcagtaaatgattcatatcctgacggagcaagccgcatcagatacccaaatgcaccatttttctttgtctctgttaaaaataacggccagataaactgcttgccaccctccggcgcaccatcctcaatattctttcgaagattattgcgaaatgcctccggatttttaatacggctgataaaataccatttaagcgcatactccctgccattataacggacaagataaacaataccctgcccacctcgtccaagctctctggagacaaccgcctcgccgcctgcctctattggaatcctctctccaatctttaactctctcatctatgttctaccatcctttatattctaccatccctcatcgtaattcacagcaccaaggtcaactgcttcaccaagaatatccttcgctcctgtgcgaatctcctccacaagtacctgctgctttgcctgtgccacggtctcggccgctggctgtctgccatttgaatctacgagtgcaagactacggcttccaatctgggaagaagtcactgcaagaagcttaatcagttctctaagctgatctgcattctttgcctgaactgcaagttcatcattcccggtaaatgcacgaagcacatccatatttaccttagaaccgataccaagcgcaatctttaacccatgctggaaccatttattctgctttaatgtatccaggcccttcttccagtcatcattcggagaaccatctgataacaggaaaataaccggcgcaaaagaaagcgatggtgaacttaaaaatgtgctacgggaaagcttcttagaaagctccataaacgcatcccccataaaggtaaggccatctgcctccaaacgattccagtactgatactcctcaatctttaccggttccggagtcacccactctacatccgtagaaaacttcataatcgcaattttcacatccgtagaagcttctccaacaccaatcagtgatggcaataattcttccatcgtactatttaacgaaccgattttcgttcctttcatactgcctgatacatcaatcataaaaaatattgtcatactcttcttcgccggctccatcgtatcaaggaaatcttcctcagccgcatctgcaacctccggcgtatcaagaacaagacttctgctcatccgattcttcttcaaaagaatctcatcatcatcaacttcatttaaatcaagccactttggcataaaaagttcccccagtcttcataaattctctattttttcaacttcatttattatataacaatttagatattttacaaactgctttatctagttctttgagataaattcttgcacgaaaagtttgatttgtaaggttggagaaataaacagacgcacccacatctcctgtgtagttcaatcctacaacacaaattctgattttgcctctccagccaaagcacatctatctggaaataaaagaatctatatttgtggtctcggagtaagtgttggatacgagcgagtagagcgagtattcaacactctgcaactaaagtcacaaatatagattcttttatttccagatggcatctactttgcctgcggcaaattacaattcacaattattcactgttcttgggaatggaatcgcatctctgatattagagattcctgtcagatacatgacgcatctctcgaatccaagtccgaatcctgagtgatgtgtggaaccgtatttacgaagatctaagtaaaactgatatttttcttcgtccaatccaacttcttccatacgttttttaagcatttcataatcatcttctctctggctgccgccgatgatttctccgatacctggcacgaggcagtccattgctgctacggtctttccgtctgggttaagcttcatgtagaaagccttgatttcctttggataatcggttacaaatacaggacgtttgaatacttcttctgtgaggtaacgttcatgttctgtctgtaaatctgtaccccaggataccttatattcaaatttatcgttatgtttttcaaggatttctacagcttctgtatacgttacatgaccaaattcagaattcaacacatgattcagcctgtcttttaatcctttatctacaaactggtttaagaaatccatttcttccggcgcattctccataacgtaggaaataacatatttaagcattgcttctgccacttccatgtcatcttttaagtctgcaaatgccatctccggctcaatcatccagaattctgctgcatgacgggcagtattagaattctccgcgcggaaagttggtccaaatgtgtaggtattgcggaatgcctgtgcaaatgtttctgcattgagctggccacttactgtcagattcgttggtttgttaaagaagtcctgtgcaaaatcaacatttccttctttatcttttggaatattatttaaatcaagagttgtaacctggaacatttctcccgctccttcacagtcacttgctgtaatgagcggtgtatgaacataaacaaatcccctctcctgaaaaaactggtgaatcgcatacgctgccatagaacggatacggaacactgcctggaatgtatttgttcttggacgaagatgagaaattgttcttaaatattctaagctgtgacgtttcttctgcagtggataatctggtgcagaagctccctctaaagtaacggtagctgcctgaatctcaaatggctgctttgcctgcggagttggaactagcgttccctctacgatcaccgccgctccaacattcatcttggaaatctcctgaaaattctcaagtttctcctcatatacaacctgaattggtttaaaaaatgttccatcatgaagcacaagaaatccaaaatgttttgaaccccggatgctgcgaatccatccgccaagcttcacttctttatttaaaaattgttcactgttcttataaatctctcgaattgtcatgatatagcaatcctttctcctacttatttttaattatattaaggcaccatttctaattatttttaattacaaaagcccgtttctattttatcgcaaactaaggggaattgctacctttttttctgatttgccgggttttgaaacaaacagacgaaccctcagcccctgttatattatttttcatgaaattttgaatctacataatcaagcaaagacaattcccaagttaaatttgcacagacagccaaagacagctcccccttgcctggggcaaattcaaatcttccttttcacccgatagatattacaagactgatttgtgagtgtattggatacatacatcatgtaaatctgtccgccagccagcacttttattccctccggttcgcggaaagataatgtttttgcaccacgaactgttattgtttttttgcttcttaccgcataattatagcggcggatttttgtcggctgatagcgtctggaacggtcataaccaaggagaaatgactttctcggactgccttcgattgtatagattgaagttccgtacaggtcaaatccctggaaatccccgctggtagcagacaaacagatccttttcactggatttcttggatttataaatcgtccctttgcaagattataaatctgataatactgcttgccgccataagtataacgaaccgccatctgcgtactattttgattgattgccggatatacattcgtcatatactttttacttttagcatctggaattttgtaatgaattgttccgtgttttcgaagtgttttatttttttgataacgaaatccagaaattgctcttgacacatcattccctttacaatcactgcctgtccaaagccatgtttgtccattcgaaaccgaacagtcaagatttgtggcatgtccaaattttttcaaatccatgtggtcttttatgtatcgtcccagtcctctgtattttactctcgtgatacgcagatttccggtatatgggcttgtcatctgtatataataataatatttagaatccattgtgtaagactgaatccagcggtgtgctgctaactttgttaccttttttatcacttttaaatcacttgatgctgcttcttttggtgtaatatctttatgtattacccttgtttttgcttctacgttcagcgcattctgctgaaaacacaaaccaaaaagcaaggcaaaaaataatatacctaatatactctgtccttttttcatactgctttcctttcttttataaaactaattcacaggtgaagtacctagagcgtgtttgaaaaatgctctagcatttacattaccaaagatttccacttaattttcaaacatgctctaaacctgattctaggttttcttatttataatatttatttagatactgtactctatgtaattttacatacgggacgcaattcatctcccaccttaaatgagagaatcttcttgctggaagagaagaaattgtatttatttttctttgtagtaaagcatacaatgacagtatccttcaaaattctcatccgcaatctgttcccgaaattctttacacatgcatttcgtgtcctcattcatttccaaacgacatggacaatatccatttttcttttttaaaccttcttttaccatctttactactttctcattttcgtttaatcgaattttcatgtttttttctccttttatatttttattttttattattcttggttctaattttatatcagatgtgagatgacgcgcatctcgtagcaagaatgccgagacattcttgaattgatgactgaaatgattttttaaacaccttctagacaattttacatttttacatatgcgaattgctgtaattttcttaaaaaatgtagtatagtataattatcacatatgtaacaaggaggaggtatattatgaaaaaatcagatgaacaggaacggaatatagctaaccggctttataatctggacaaaaaagtttatgagacaacaggcagtactttaggacgtgtctttccttccagtccatcattcgcattagagaaaattattgatgcactcaagataaatcgagaatattttcttaaaaacgagatgacactaattgccaacatgatcggaacaatccgagacgaggaaaaggccgccccattaaaacaggagtatgacgaactggagaaagatatcctcgcctacaatcctacgattatcttgcctcacagcattgataataatgatgccgttgcctcccgtcgtttttcttctgataaccatttaatcatatgcatcagcaggcagtttggaaccggtgggcacacgattggttttgaactggctcagcgtcttggcatcgcctattatgataaagaaatcattcatcttgcctgtgacagaatgggcttaaactccaaagatgtaacggattacggtattgacagttccggcagcagccgtggaatcttaagcagcatcggaaaggcttccaagaagtttttctccacacagtctgatatgcttttctttacccagagcaatctaatctgtgaaatggccacacaagaaagttgtatcttcatggggcgctgcgccgatgtagttcttaccaataacaacatccctcatctttccattttcttatctgctccatttaaagaaagagtaaagtatgagatggggattgcttcctgtgattataaaactgcttctgcaaaagtaaaaacaatggatcaggaacgtaaaaattattaccagtattataccggccgtcagtggggatatgccggcaattacgatctgtgcgtgaacacatttttctatggacacgatgagactatccaggttctctatgatatggcggaaatgtcctgtaaaaaatagttcatatactgtcaattttatattcttgatttcataagaagattttttgccagttatacaaaagcatatacaaacatataccgcaaattggggcgtgcagattgcaggaatgattttttcaaacacgctctggaatatttaaaaggcagggagattctatttgtaatttccctgccttacttttattgtgccggtctggcaatctgtgcaactcttccttttcttgaagtgtaatctctctttaaaatagatgggtaatttccagtaatagaagacattgtatatcctactaactgattatttctccattcatatcctacaaagatttctacatgatatatatttttgtatcttccgttatatcccttcttgtaaaacaccaaatcacctggcaaaagttttttcttgcctattgacacaccgctgtttgctactactttgcccttcttagtagaccagagcgccatgcctgctgctgtattacaccaggaggtacttcctcccattgtaattccctgtggtagataacatctgccacaaaatgaactacaatccacagaacgcttacccattctgtttccctgactgtaactcatatttctcgcactatggaactttttcgctttttctactgctttatatgcttttttactacacacagatacgatacatttcaaggttttctttccaacctttgcctgaacaatagcgttaccctttttatgaaatgtaaccgttccatcctgtgaaacttctgctacagatgactttgatgaaaaccagatgatattctttcctttctttacattctttaccttaagctttactggagccatccccttataagccgtgactgttgtcttatttaatgctacactcttacgctttgcctgtacatttccctttcctgcaaatagcaaaactgccataaaaaagacagtaaaaaagaaaattctctttcctgtacgttgatatgtactcatatttttctaacactccctcgaataattacatattatttatcttttttctaaaatgctattacaaacaacacggttatcattttaccatattttattaaaaaatgcacacaaaaatttaatatatttgtaacatatatttcccttgtggacattttcagagaaagttataatacaaacaggtaaattgaattgcaaatcacacagcaaaacaaactacaaaaacaccgatgatatttaaatatatcaacatacttaaaaacaagaaacttcagctttcacgagctgaagagttcacaatatttatcaacgaaaggatttacttatgaaatttcacagagttttactattcacttctatccagatggatatcactccagtaggcgatgaccttcatgtacttcttacctgcggcggagaaaaccgtctcggctgcaccgctttttccacaccagttacagataccgaccctgtagaatgcgagacttccgttatcacagacgtagataatccagaagatttattctgcccttatattgcagaaagcctctgcaaaaagaccggacagcgagttttatgtactggtggaatttttgtggagaatcctgacgaacatcagatagataaactttacgaaaacgtagatgaaatgataatggactgggttcattttctggattaatcatttcgtatctggctaaaagcagacgaaaaacaagagagcatataatccctatctgtgactttcgtcgcggcgtgttgaatgttcgctctactcgctcacatccaacacttgctcccaggccacagatagggattatatgctctcttgtttttctgactttggctagataactttggctagatacaatgaattaaatcagaaattgatactgggggatttggggacagaaactgatgtcttctacttactcgaaaatgactgggaataggggatatgatttgacctgcctatatgtaatagtaagataaaaaaatatctatctacaatatcctgagagcaagcagaaaacttctgccctctcccccaaatccccacaaccactatttaattcaaacaaaatccagccaaagacagcccgcgaagagatacgatatcctatatttgtggcctcggagcaaggtttagatgcgagcgctttaagcgagcatttaaaccgccgcgactaaagtcacaaatatagaatatcgtatctcttcgcgggcgtctgttcttaatgaatcaaatagtaatctatccattcgtctaatgttaatggtacatagtctgaatacatacaaaaacaattaatcatattacagggaatcggcatcggttcttcatcatatttgctctgtctctttgtctctctcgtaatctgacagaactgccgtacaagctgttcatccattgtgtcgtgcacatgtccgtaaagcatataggtaagtggctctccttttttatttcttcgatactgtccgttataacagaatatcgggtagtgggataagactacttttcggcggttatcgtgcatttctgcgtatggttttatccagacaaaacgttctttgttgaactcgctatcttttaaataactgtcatggtttccttttatcatataaagcgtgccgttaagctggcttaatacttcatttgtctctttcgccttgcccacagagaaatcaccgagaatcacaacctcgtctttggggcggactctgctgttccactgttttatcatataggcattcatctgggctgagtctttaaatccacgacagtccatctgggtgtttagactttcgtggaaaaaatgcagatctgaaatataataacgcataataattgtttgctcctctctggaaagttatgactgattaaattcattgagtgaacagcaaacagacagacgaatcatgaaagcaaaatattccctatctgtggctttagtcgcagataggggttatattctatctttgggttcgtctgtttcccctgataaatttaaatagcagcttgagagcgtctatgtaactaaattaccagatcatccaccgaaatattctttcctgtcaatccgataaaggctccttcttccccgccttcttcgtgggcgatgagccatttatttttggcgaaaagtaacttttcttctggaagtttttcctcttctgcttccgctccaagctttactccaagcgggaaatttgttccaaatggtaaaataactcctgtcttaaatgcgtaatcgttctcttttgttccaattggtgtgtaatgaagtgttgtggcatacagttctactgcggttcctgcgggaacaaaaaatgcttctaactgtgcggtatcgtatttgaaatcatcagtaatatctgactgctgtcctaacagtaaaatgacatcggtcgcagcgacatttgcctcggaagaacgatgatattctaatgcattcaacactttgttgtgtccacaacagtatccaatctctacggaaagttctccgtaaagtgtattggaaattttctggcggaaatctggttcttctaatggtccaaaggaagctgcatattctaccgtctctggatacttaatcttttcgagtacattgtaaatctctgaaaaatcaattcctgttaaaatctttccatacttcttgaaagaagcgtctgttacctgtttcaccttcattataaatccccctgtctttgtgagcggctacctcttattcgaacgccgccatatctttcttttttcagcttcttttatgagttcgtccctgaaatccgggtgggcaatagatataagcccttctgccctctcccatgtagaacgaccctccatgttaataacaccatattctgttgcaagaaaatatacctgacttcgcggagaagtgataatatctccattaaactgcggcaatactcttgaaaaaagctggccgcttttatccttatatgtggagctcatacagataaatgcctttccccctctggctgaagacgctccaattaaaaagtcaagctgtcctccggtaccgctgatctgccttgcaccaaagctttctgacgatacctgtccatataaatctacggaaacacagctattaatagaaaccatattgtcaatctgggcaataacgtccggacgatttacatattcaagtggatatgctgctaccccatgattatcatctaaccattcataaagctccgaagagccaatggcaacaccgaatacgccttttcccctgtcaatcgttttctttttattggttaacttgcccgccttatacaaatgcagatatgcatcggaacaaagctcggtgtgcattccaagatctttgcggtcagtttctgctatcagctctccaagagcattgggcatacttccaattccaagctgcagggttgccccatcacatatgtacggcagaagattctgtgcaatctttcggtcaatctcagacggcacatacggcttgcctgtcgtaaaaggttcatgctttccctctacgatataatccacctccgacacatgaatacattctccatatccaccgtgtatctttggcatatgctcgttgacttctacgataacaacatctgcattctgcacaataggcccggcaactccggtatttaccgaataattaaaatatccatgcttgtccatcggtgagacactgaccattactacattgacatttaaaaaatacttataatacgcagcattgttgtgaaataccattggaatataataacataatcctctgtcacaaagcttcctctcataagcagaacaatgccatgtatgatagacaaaatgttcctgagtctcgtcacattctgctacctcaatcggcccctccacaagattcccccgaatctttacatcaaaaagttcgtctctcctcttagcaagagccttatctaaaagaaccggctttccgagcgagctggtataatccacccagtctccactctttactacttctaccgcctcttccggtgtacaaagcttttgtctgtactcagtcataaaatcctttaacaccgttcttctcccctctgtatttctctctgtttgccagttgcactgacatatcttccaattctttcaccattattttaacaagatttgtgctaaataacaagaggatgtggggaatttttggagttggcaaaacagacgaaaggtagagtgccctattatacaataaatgcttcgtatcactgcacttaaactgctcaaccgcagtttaagcttgctctagagcgtgtttattgtataatagggcacgctacctttctgacttttgcaaggaccataaatttcccgtacaatctggttgctttttaagttacaaatttttcttggggatagatttgaggttgagaactgtagatttctgcttgctcggaagttaaataacagtctttcctacatctccccactcccaccctacttcttccacacttctttttgaagaaaaaatgctatctatatttccaacttcctcaaattcaaaactactcgctcttgtcgctacctgaaataattctacaacacactcatagagttaacaaatttaaatttggaaaacatttaaaataacttctgtcttccaaaaaacagaaccccaacagataaagactccctatttgtggcctcggagcaaaggctggatgcgagcgtgtaagcgaacattcaacctgcagcgactaaagtcacaaatagggagtctttatctgttggggttcgtctatttagccaaaacccagaattatttatccagcttcttagcagcgagcattgtttctaccaccgctcttacgatagcttctaatccttcttcgtctactttttcttcttctggaacgcttaatgcagcagttacgatagacatgctgtatacttcttctgcgttacatccacggcttaagtcgttgattggagcgttaagtccctgtaatacaggacctactgctgtatatccacctaaacgggaagcaatcttatatccgatgttagctgcgttgatgtcagggaagataaatgtgttagcctgtccagctactggtgaaccaggacattttacttctgctacttctggagatacagaagcgtcgaactgaatctcaccctctactgctaattcaggagcagcttctttaatcttctttgttgcgttagccacctttgttacagaaggtcctttaccagaaccaagtgtagagtaagataacatagctactttaggatcgattccgaaaatcttagctgtcttagcagattcgatagcaatctctactaaatcatcttcggatggatcaatattgatagcacagtcacccatagcaatcttctcgtctcctcttacaaggatgaagcaagagcttacgatgttgttgcctggttttgttttgatgagctgaagagctggacgtacagtatctgctgtggaatatgtagctccacctaacagacagtctgctccacccatttttacgagcatagtaccaaagtagttgctcttagaaagagctgctcttacctgctcgtctgtcattttacctttacgaagcttaaccatctctgctaccatagcatcaattccctcgtaattttcagggtcaataatctggcaggcatcaatattaaagttacctgcttttgctgcagccttaacttcttctggcttaccaagaaggacaacgccgagaattccttcctgtgtcagacgatgggctgattcaagaatccttttatctgtaccttctgtgtatacgatggtacgaggattcttctttaatgtttcaatcatttttgttaacataagatacctcccaaaatatatctttgtctagtagtatcaataatagtacaaaatacgctacttatatagtaagccctgcaccatgttttttcaacaatacattgatataaatttttgactacatcgtataaaagaaagtacaaaaatgcatcggaatttgtataaaaattccgatgcacctttatttttttgatatttaaattatacttttttgtgaagtcagcaattctggcttatcatagccaaaactttctgcttccatcataaatcatatgataaatcgacatatgttttttcaacaacataatctatattttatcatttataacagtatgcgttttgtctctattctactgtcatcactgcttcacgattccttttttattctgctaatactttctgctgttcttctgcatcttccggattctcatggaaaatggaataagcaatgtttgtagagtggtcagcgattctttcaaggccaattaccatatcggtaaagataaggccgatttctacaccgcatactcctttggacagacgttttacctgctgattctggtaatcaatctgcatctgatctacatcattttccatgtcaatgatctcatcaatgttgtcctttttatttgtgacgaacatttccatactcttatcaaaaagctgaagaacttctgtatacattgttgtaagttcttcctttccggctccggtgaacttctcgttaagctgacttctcttctccgcattctcaaggatattgattgcgtggtctccaatccgttcaaggtcaataacaacatggaaaagagcaccaattcgtctggaatcggcaagcggcagttcataacggttaacttctacaagataatccgtaatctcgctgcttaagtaatcaataatcttttctctggcattgatttcctttaccttatcaagattcttatctgctaatgcttccatagaagcaacaaggttttctctggccagaccagccattctctcgatttcctgaataatttctactacggctgtagatggcacaaacttgcttgatgcctttctgatatattcaagatgtaatccgttatcctcttcctcaccttctttatttccaggaataaaaagtttcgtaagttttacaaactgtgatgcaaatggaaggaaaataatcgtctggaatactttaaatgctgtatctgcattcgcaacgaaacgtttcgcattatctgctccaccgagaacagaaatcgcatcgacgatctgatttctcgcaaagaacagaatcgttccgataatgatcatacctaatgcattgaataagaaatgtaccatggctgtacgttttgcattcttatttgcattcattgctgccataactgctggtgtacaggaaccgatgttggcaccaagaataaagtacagacagcttcctaatccaaccagatgggaatccgctaataaaaccagcacactgacagttacagaagaactctgtactgctactgtaaacagtaaaccaacaagtaatgcgataaatggattcttaagataagaaaaccagtgcatgattactggatattccggaattctgctcaatgcacctgtcatactgttaattcctaaaaacaacgcaccaaaaccgaagattacctctgaaatctttcttgttatcggcttattgccaaacatcatcaggcatgcacctgcaaagatgatatacggtgcaatggcagtcagtttcaaagaaacaagctgtgcagtaattgttgtaccaatgttggcaccaaatgtaataccaacggactgttccagtgtaagaagtccggcatttacaaagctgacttccataacggtggttgcaccagacgactggataatcgcagtaaatatcgcgccaaaaataactgcaatgaatcgattctttgttacacgatccagaatgacacgcatcttatcacccgcagccttctgcagcccctcactcatgaacttcataccgaataaaaacagtgcaagtccactcagcagttctgtaagcataactaacatgatattatcctctcttttgttttctacttaatgttgtaatgatttcttcaggcttttacacaatcattacgttttttttacatgacattaagtattctaatatattttaacgcaaaagaaaagacaaatcttttggcatttccgactcaattctcattactttttcacagaacggatgtgtgaacgtcaactgttgtgcatgcaatgccgtccttgaaatcccaagttccggaccatctccataaaaagaatctcccaaaagcggacagccaatcgaggccatatggaagcgaatctgatgcgttcttcctgtctcaattacaagagaaaccagactgaacttttcaaatcgtttcacaacttgaaaaaatgtttttgctgtttttgcattttcgctcttccccactttcatttttaacttatctccatcacgagcatcccgcatctcttccattggaatttcaagaattccctcttctggaggatttcctttgaccaacgcataatattcttttatcaaaatacccctctgcctttgtttaatcatacgctccgctgtcacactgttttttgctattcctaaaattcccgatgtttctttatctaaacgtccaatcaaatgaatattactccgttcgttcttctcccgtccctcattctcaaaatacgcctgcaccccattaatcatactgtcactcaaatgccccttagatggatgcgacacaattcctgccggcttatccacaaaaatcaaatcttcatcttcatacaaaatatggagattcatctttgtagatgcaattttgttctgcttttcctgcgaatcttcaagcatcacttttaagagctgtccttcctttcccctcgctctaaccgtcactctcttcccatttaacagaattccccactcctcatgttttacagaacgaaccttttttgtcgtaaatcccagcaccttttgcatcagaaaaagaacctcttttccgtcatcggtggggcctaatctatattcaagataatgtgtcattgttacctccttatgaaacttttttgttcaaaaaaacagacgaaaaaagctgtaatcgggaagaaccatttacagcttctttctgtgctttgactggacaataaaagttagtttgtatcctatgtaacctgcaatagctccagttatgattccacctaatacgtctgttggatagtgaacatataaatagagccttgaaaatgcgataagaacggcaaggactaatgctattttccacagttttttctctccggcaagatacaatgccattactgctgtaaatgaggcggcagtatgaccggatgggaaggaatagtcgtgtggttttgctacgattaattgaatggcggagtttacgtcaaatgggcggattcttgctattagtggttttaatattccgttgcataaaatcaggtctacgattaaggctgatgccagaatcaacccactttttcttgttttcggaataagcagcaacacaatcgttaataaaatccatacgattcctgcattgccaagttttgtgatgttactcataaatatgtccaataatggagttcttattttttgaagcatacttaaaatttctatttccatatgtaaccttctttctttttttaaatatgttaaaaatactttcaatggatgtgctaattacaaaaattttctttaacacgctctatttttctacatataaaatcacaaatatagctcatagactctattggcttcatctatagtgtatcttctaattaaataacaaaaaaggcatagacttcgaaaaatctatgccttatctgctttctcataatgccggcgatcggaatcgaaccgatacgggagtataagtcccgcaggattttaagtcctgtgcgtctgccagttccgccacgccggcaaagaaaaaaccggtcgttccggtaacttcttacacctgatgttactcaagtgaatgggcggaggtggattcgaaccaccgaagcaatttgcagcagatttacagtctgtcccctttggccactcgggaatccacccattcaagtcgcattactgcgcctgacaatatcgtattatataccatcttgtttcaaaaatcaagaggtttttgattaaattttgatttgtttgcagaacagacgcaccctaagagagccgataccctatatttttgactctatcgctgcgggttgaatgttcgcttatatgctcacattcaatctcgttctaaggccacaaatatagggtatcggctctcttgggatgctggctatggctactaaagcaaaatgaaaatttaatgttggaggatttgaggagacaccagaagtttatggctacttaagaaactagataaggaaaaactgaaaagcaagaatttaattgtattgacattttattactttataattataatataattatgagtgatatcaaatttcaatggaacgacaacaagaataaaattaatcagaaaaaacataagatatcattcgaagaagcacaaagcgtattttttgatgaggaagctttaatcattgacgatccagaacattcattagaggaggaacgtttcataattttaggtcttagcaaaaaggctaatcttctggttgtctgtcactgctatagagaatccgatacaattatacgcattatatctgcaagaaaagctactgtaagagaaactatatcttataataagaatctattttaatggaggaatgtattatgaaagatgaatatgattttacaaaagccagaaagaatccatatgctaagaagttaaaacaacagattactattaatattgatgtggacacaatagattatttcaaagaacaatccaagcagtcagggattccttatcaaacattaatcaacttatatctcgctgattgcgtagcacagaaaaggcaattgcaaatgacgtggaaatagtaatttgccagtgaaataataattgccacaggcaagaagacgctcccaaagagagcaggtatcctatatttgtgactctatcacttgcgggttgaatgttcgcctccgcgctcgcattcaatcctcgttctaaggccacaaatataggatacctgctctctttgggagctgtgttttggctggagatggaattactatttcacgttggggtgatctggagaatcgccagaagattatggctttttaaaaagttgagtcataagagttcgatacttatattattgttttaatatgtaaaaataatattttttcttatggatttctgtgtcaattctttgaaatttagtttcccagatagctttattctcctgtcttctcccacaaatctttccacaaatttgctcgggcagccaagaaacagaagtgtgagaatccaatcctctatatttgtggtctgggagctacgagactataataaaatgttagaaaaggccggtattaaaattattgattttgatgactttgtgttttgtacaactgagtcaaaatcaataactttaataccgaccttttcttagaatactacttctcgtagcgacgaaaatcacaaatatagaggattggattctcacacttcgtctgtttactcaccccgacaaattactatttttctatctctactgctttaagaagaatcgccgatactctaggcagtgtgatatccagcactcccgatgttacgggatgtactttcttctccattgtgtatccttcctcattactcatgatgacttctaccatctcttcgtcatctgtaactccaacctcccatacggagactttgactcttgcttcgtcaaaaccagagttgattaagacaaccattttctcggtgtcggtgaaacgtccgtaaccgagaactttgaagccgccataaagatatttgagggagcctttcattaaagcttcttcttccttatggatggcgataatatctctgtggtactgaatgagattctggtcttctcttccccacggataggttcttcggttatccgggtcagtccagccgcacagtccagcttcatcaccgtagtaaagggttggcgcacccggccaggtcatctgaatcatgacagcagcacgcataatacctttgttaacattctggttggcggcttccgctcccatacttgcagtacgtcccacagtctggttcgttcttgttaagaaacgggaatggtcgtggttagaaagctcattcatggaaaccatgagtgacggatactggaatcttgacatatgatataccattgcatctacaaatgcctgcgtattaccaagaagatctccccgccgttcatcgctatgcttttccattccggttaaaaaccaggtaactggttccataaatgcactgtagttcataatggtatcccactggtcacccataagccaggaaccggcatcttcataatgctctgctaaaatgatagcttcaggattggcttcttttactgccgttctgaagtctctccagaactggtgattgaagtcctcgctctgtcctaagtctgccgctacgtcaagacgccatccatccgcattatacggaggggaaacccattttcttcctacatttaaaatatagtcataaagctgtctggattcctcatagttcaattttggcagggttttgtgtccccaccagccatcgtagtcatcgttatacggccacgcattctgattatagaatttaaagaaatggcggtatgggctgtttgcatcgacaaatgcacctttttcatagccatattgattctcatagatacgttctgcgtccatccatttattaaaggaaccgcagtgattaaatacaccgtcaaggataactcgcatcccttttttatgcacttcttctacgaaatgaatgaaaaactcgttacttgcctcaagattgcgtttgtctgtgacacgggaaatatatttacttgcgttcatgttattattttcccagtctggaagtgtatttccctcgtccacaacaatttttccataatgagggtcaatataatcgtaatcttgaatatcatatttatgattggatggtgacacaaagattggatttaaataaatgacatcgactccgagtccttttaaataatccagatggtcaagaacaccctgcaagtctccaccgtagaagttgcgcacatccatttcttccgggtagcgataccagtcatctatctttttcgatggctgattgatataaatatactctctgtttaaaacatcgttagacgtatcaccattggcaaatctatctacataaatctgatagaaaatcgcacctttcgcccagtctggtgtagaaaatcccggtgtgactttgtaattaaagaaaggctctaaatctcttgcagggcctttcttgttgaaataacagcaggtacctccggaatgaatctcaaaatagtaatccgctatctctgtccccataaaaaagctgctctcatagaaatcgaatcgctctgttttagaagcaatctgcatctcctttttctcaccatttacacacaagaatacatgctctgcattctctcttgcggtacggaaacgaacagtaacttcgtctcctgtctttggctcgactggattcatatagttgctgcttccatctgtaaataacgcctggaaattcaatactggtttcgtatgatagctgtaaaattgcaatttctctgctgcggaaagatttcgtattagattttgaaccatctccataataactacccctctgctgtttgttttttcatttctgtctacttacacatttattataataattcaaatttctattcgcaaaagcaaattttccaagtatactttatgagctatatcgccaaaacttacaataccgaaagtattcataaaaatgaatatcttaattgcactctcacgaacagactttgaatctttgttttttactttctatttgccggttctacgttaattgatttacctttaatctttacgtttttcattgcttctaatacatcagatgcaacttcacgtggtacttctacaaaagtatatttatcgtacaagtcaattgttcctactaaattacctgaaattccggattctccagcaatcgcacctaagatatcacctggacggattccctgtttctttccgatgttgataaacagacgaaccattccttcttctgcaccggtatctccaaagtcttctttattacttccagcgtctttgccgtctgcagttccaagaatctctgcaaggaaagctgcggcaacgtccattgctgtgtagtctttctcatttacaaattcttctaccatgtcaatgtatttgtttaagttctggtcttcgatatagtggtcaatacgatcaaaaattttctctactcttgtctctgttacatcgttaagagatggaattggctgtgccttgatctttgccttgcagtaacggcggatgtcttttaacttgtaaacttctcttcctacaacgaaactgaatgccataccagttcttccggcacgtccagttcttccaatacgatgtacatagtattcttcatcctgtggaagatcgtagttaaatacggcatctacatcgtctacgtcaatacctctggcagctacgtctgtcgctacgaggatatctgtcttgccgcttctgaaacggtgcataacgcggtcacgcatggtctgcttcatatcgccgtgaagcccttctgcgaaatatcctcttcccttaaggtctgcaactaactcgtctacacccttctttgtattacagaatactacagacagctttggatcgtaaatatcaagaagtcttgataatacttcgctcttgttctttggacggacttcatagtagtactgtgtgatattgggaacggtcagttcctttctgatcactttgataatctctggattctgctggtatgctcttgcaagctccatgattggctttggcattgttgcggagaaaagcattgtctgtctttcttccggcacaccatttaagattgtctcgatgtcctcacggaatcccatatcgagcatctcatctgcctcgtctaatacaactgtatgaatattgtcaaacttcacagtctttcttctcatgtggtccatcatacgtcccggtgttccaataataatctgtacgccagcctttaaggaacgaatctgtttggaaatctcctgtccgccataaattggaagaatctttacggatgacatatattttgcaagcttacgaatctcatcagcaacctgaatagccagctctcttgtaggacagagaacaattgcctgtggtttcttaagcttaggatccactttctgtaaaataggaataccaaacgctgcagtcttacctgttcctgtctgcgcctgtccaattacgtcctttccagaaagttctaccggaatcgcttttgcctggattggggacattgcctcaaatcccatgttagcaaccgcttttaaaatttccggttttatatcaagttctgtaaattttactgtctccatgtaatgtctctctttctatttttaaggatgcaataaaaattttaaattttttataaaactgcaactatactcccatgcatttaaaccataatttttatataattgaatctgaattataaaaaatttataaacttcctattgcaaaaaaaaagctctatcatccaacaggaaatagagctaagttaacggcactcttgtctttaactgttatctacattttcttcttatttatcatagcacaggtaaaaatagccgtcaaatagaaaattaccgccttttttcttctaaagtacagcacttttccacattttttattgatgcggtgcattttcccacattttaatgtaaagttcttcccttctgtcattcttcataggaaatgttttgcgcatttctttgatttcttctggatttatgtctccaatcagcaaacattcttcttctcggattgttgtcaccgcctccccatttggagagtaaatagccgaatggccgttataatgcaggccatccccctctcctgttcggtttacgccaaccataaatacctgattttcaatcgcccttgctttaaggagcgtatcccactggtcgattcttgactttggccaattcgctatcacaaaaataatctcactcttttctgaactaatctggaaaatctctggaaaccgcaaatcatagcagacaaacgctccaagcgttgttcctttccattccacagactttaactttctgccaccctgatagtactccccctcaaatccataagaaaatggatgaatcttcgcataatttaactttaactctccattctctgcgattcctaaacgattatagtaatgattccagttcggatgttctttcaaacgttcctccggcaccggttctgtatatccaaaaacagtcaatatcttatattttttactcatttcctcaaaaaaatgtttctgattttcggatttttctcctgtctcttccacattcattgaaaaacccgtcagcgtcatttccggaaaaacaagacagtctacctgattctcctcggctttcttaaaaaattgttctactttctccttattatcttcaatattttcccagcttatgtccatctgagccattccaattcgcatggtaaatcctcttcttctttcttttgtctttgttttatattaactttatttactctttgtagctatttttcaattatcctttaaacatatcagttttgtcttctatatatctacattatttttaataaaacttttgagcgcatccctgtcaatatttattactttttgtttatttactctttgtttctcttaaattctaatttattcgcctaaattctcttgttcgtatttttttctcaaaaacccctcttgaaattgcgaaccccttgtgataatattcatattaatgatacatggtttttaaaactacgttgtatgacatttatatggattttaattttttaaccggatatacaacctttcaaatcgtgtgaatgcaatgttttgaaaagctgcaattccattcaggataagaaaaattattttcacttatccatttatgtattctcagaatctttctgtattcttttttgcaagaaaaattccagaaatgcatattctatgacaggaggttatcattatgaacaaaacaagtaaaaagtttaaagatcccggcagtgccattactcatttaatcgctatgatcggtgcagttatctgtgcttttccacttatcggcaaagcagtacacacgaataattccatcgttgtttttgccatgagtgtatttatcagcagcatgattcttctttacggagcaagcaccctttaccattctttggatatttcaaaaaaggtaaatcttttcttccgaagaatcgatcattccatgattttcgtgctgattgccggttcctacacaccagtttgcttactggcactcgatagaaagcagggaattccgctgcttgtccttgtatgggctactgcaatcatcggcattatcataaagatattctttattaactgcccacactgggtaagctctatcatctatatcggaatgggctggacatgtgtacttgtcttcaagccactccttgccagtctgccagccagtgcatttgcatggctccttgccggaggcatcatttacactgtcggcggtattatctacggattaaagcttccgatttttgataagcttccaaaggacttcggcagccacgagattttccacctgttcgttatgggcggaagcatttgccatttcatctttatgtatgcttatttgatgtagggttgctgctacattttttcagttattgataacaggctacatgactattaatttatatcatataaaaggctatcgtccatatagttatctgacctcaagataacttataacacactttatatgattaaatcaataaagatttagaaaaagctcgcttcattcacagctatctcccaaagtatctttaaaaaatactctggtggctatgaataagagcgagcttcttttgtctggaaagctgcttaatcgcatactcccttttcatcgcttcctgcttcgtgtcatactcctcaaaatacaccagctccaccgggcggcggttcttcgtatacttggcacctttcccgctgttatgtgcctccagccttttcttaagattattcgtccagccagtatacagagtttcatcactgcattttacaatgtatgtatagtttccttgatgttggttttgtttgtcagtttctttcattatcttttaccaattatcgcttttctattgttttcttttttacttttctattgttttatccttctgccttttttatgattttcttctacagtttatcaattcaaactttttattatttcctgccactactttttatcgcaagcactttattatttgattctttaccccaaaatatcctattatcttttgctactacctcttgacataatgaattttgtgatttagtataacacattttttcctatctgtactttctttttggggagctcactctcgtaaactcccctattttcatcagccggaacaatcagtaaatcatacaatatcgtaaaaatagcaaaaacacaaagttagttatcaacatataaaaaacgagaaagatacatgttagaaaattccggctgtatttttataagactcatttttgcaaattccttatcttcacaactattcagaagtgattttcctaaaatcatttttcttctgaatagttattcatattactatatgcaatgggaaatcggacgttccttatactcgaagatatttcactggattcactgtcttatctttatacgtcatcttaaaaaatacattcggtccttctaatacaaaagactttgttggctctgcaactgttccaagaacatcgccttcctgaatgtcatccccaatctcatagtcaacattgtccagttgtccacaatatgccttatagtaattcccaagtaaaatcgttaccactttgccataacggtcggtatcttcaatattgacaactcttccattcgccggagagactacttcctctccaacctttgctccaacaataattccatcattgcaggcatactgatcaagtgttgtataatacactgtcgcatccatactgtaagggagaataatattgcccattaccggccaggttaactttttctttccgttataattgtataccgaatcaccacttgctccactgttctctgcgttatttcctgcattttcttttgttccacttatattatttttcgtattattttcatcttttgtatctgcgtcatcctgttctgaagaactgtttcgccctgaattattactgtattttgttccttcaccgttatcctctgcattgctgtctaatgtatcagtcccgttctggccttctgctcccggctccacatccatatcattattcgctgcggaatccgctgaatttgttgctgaacctgtatcattcccggacactggaccaattacatcgttacttttctctgttgtttctgtctttgtcttgttatcagacttgcccccatcggcattgcctattttaatattgtaggcagtaagcactgataagattaaaaaagctgcaatcaccaaacttgaaatatattttttttggaataagttatttggtcttttcatttcatcacctctgggtatagtctttaccagaaaaatgaaatttatacatggaattttgctgaggcaatgaatagacgaaccattgcgacccaatcctaattctgttgacattgttttatctttatacatttcgtgaaatgtttcataatctttattataaatagaacgtatcatatcaaatactatgctgatatcctgatttcgaaaacagagactttcgctttgtcttacctgtatcagattcattctataatcagatactaacggctttaaatattctggtattaccagcatatctagtaaattaaatggtccgtcccattctttttctccatagtatatacataaacttattaccggatgcagacggtcatccttttttaacgctgattattcttccagaaagtctttagtatagtgtctggtttcacttgatttctaacaggcaattcgacaccatcctttccctcttatatacctaatggttatttatatttatatattaccatatttttctttatttgtaaatatatttattcaaaaaatcctgatttgtgaggctgcaaatcagatgaactcctgaagataaatctccctcaaatctttctcaaaataaattctgagtttgcatagttagccaaaacacagccctctgggaatgaaataatccttatttgtggcctcggagcaaggtttggatacgagcgtgtataagcgagtattcaaaccgccgcgactaaagtcacaaataaggattattttcattcccagagggcgtctattttgcctgcggcaaatcaggagttacaaccttcgttccaggatagtaatacgataatatcgttgctgccgtaatctgtttctccgccaacgcatttgccccgtaaaggctcattcccatatcgtgaccttttccgacggtgaccatgcggagtttcccgttatagttttctaaatagaagttggtggaattcagggcaaagattttcttccattcttctcctgtccacttattatcctttgctgtaatttcctgtacgaatccattctcggtatgttttgtgattttcaggctgctttttaatatttttatattctggcttttatctgtttttgcaagatttccgctcttgtctgcttttgtaagtttttgcagcacctcatcataaggaagaaccttcacatccatgtaatctggtgattctacatcctgactgctgtccacactgatcaaatatggtacggctacggagtacatttcttctgaagaaactgtttttccaatgctaacctcatgataaagtgcatcggcatatttattctcgtaagtaagcacctgtccaaaagttgcatcggaagcatcctcgagttttttctttatttccaaatacgctttccgcccattattctcttctaattctttcatggaaatgtaatcgagatttagattttcttgtctgatattctgatatttcctgtttatgatttctgtgctttgtacgtcttttacattatttgaattttgtataccgactacatttgttgtattacctgaattttgtgtacttgctgcatttgctatatttctcgttttttgtgcaactgtcatatctgtttcactacctacttttttactattactttcaccggaagctgccttcacaaaatttgttctgcaaacaatcatccacgctttcaatgcttcctcctcttttatgtaggataactcggaagcagccataccgatgacaaattgttctccgtccatcttttctccatttttcatctcaacagtaattcccatttttatatccgcaacacccatattcccggagatgagaatggttgcgatggtggggatgagaagcgcaccaaagatgaaaaggatgtataaagctaatttcttcattgtatattatatgcaaaaattttgattcatataactagagcgtgtttgaaaaaggctttctgcaagatgtgcgttacaatttgtgggagatttcgcctgaatgaaggcggcatagcgggcttcgtctgttagttgcttaatgaattaaatagtaattatctgtttctttccctcttgtaaaatcacaaaagaatacttgtaatttatgacggagttacatttacattaagggcacatttttatataatatacacatatagcataaatcatgatggattagtgtgtgcattggtctgctttttacatttatttgcattaatatgacaaatcttgttctctgtggctactttttagctgtgaaatgaactgctgagatggattactgaaataaattagtgtattgtctcattgatttttaatcaactaacatagaaagttttttctggatagtgcactttacaaaagacagattgatggataacgaaaggaggaatccatgacgaaggatatgatcaataacggggttaattcagatgataagtcccgtattattcaggagtatgttccgggtaagcagattacgcttgctcatatggtaacccgtccaaaggcttctgtttataagaagcttggtctgccggatgattatcatgatgcgatcggtattttgacaatcactccttctgaggcaacaattattgcggcagatatttgtacgaaggcggcttctattaagttaggttttgtagaccgtttttccggttctgttattattgtaggttctacttctaatgtggagtctgcgcttaacagtgttattactactttttataataagcttggttttgatacggtttctattacgaagacttgatttagatacactttagtttggagattatttttttatgaaaattatgttgattggtccgtcggcagcgggtaagactacgctaattcagcgtcttattgatgaggagattaagtatgataagacgcaggcagtggagtatattggcaattttattgacacaccgggtgaatatatgcagcagaggggatactggggttctttaaccattacttcccacgatgcggatattatcgggctggtgcaggattccagtagtgaggattgctggttttctggcgggcttacaagtaagtttgagaagccggttgtcggtgttatcacaaagattgacaaagacgattcaaatccaaagcaggctcgttcctatctggagcttgccggatgtacgactatttttgaggtgagttcctataccggagaaggtgtggaggctttgtctcagggattccacgatatggtgaataagtacagggaagagaataaaggccgctatgccgatgattattttgattagaacaggaggtggtaggcttgattacactatcaaaggagaatgtcgttgattatgtgaagtcaaggctcgatttttttaatcctgatggagatattaaggtttctgcaattggagaaggtactgtagaagaagatggagatggttttattaactttgtctatcgtgtttctgatggagtgcatcatctgattgtaaagcagtctactctggaatctcgttctaagggcagttttactttggatttaaaccgctataagttagaatacgatgctatgaagatctgtgctgcgattgtaccggacctgattccgaagttatatgactgtgatgaggagaatcgtgtatttattacagaagatgtttcctatcttcgaatctcccgcttccagcttttaaagggtgttacttatccaaagcttgcagaccagattgcaagatatatggcagcaacacagttttacacttctgaatattatttagatacaaaacgttttcgtgatctgagtgttcatttcatgaatacaactatgcgaaagattatggaagttggtatgttcctcacaagtgttacaccagaagatacggttggacgacctcttgatccggaatttgttacattttccaagagaatctgtgcagaccctgctgttctcttagcaagacagaaactgagacatctttttatgtctaagggcgaatgtctgattcactgtgacctgcatacctccaatatttttgccagccagactgaggcaaaggttattgatatggaatatgcgttcttcggaccatttgcttatgatatgggatattttaccgcgaactttattgcacagtatgctgccgctgctttccgtccatttgagacagaagaagctcgtaaggaatttaaagcatactgtctgtttatgattcgtgaaacctatgtgaagtattgtgaatatttcacacagtactgcaaagaagattccaaagtcgaataccataacattcctggtcttgcagaagacttctgcctgactacacttcgtgaatttattggattcgctgcaagtgcaatgcttggtcgtatctgcgatcttattccatatccggattacgatgatattgacgattatgtacagcgtcacaatgctaaatgtttctctatcattttaaacagggaaatgcttgtaaaatgggaatcttataattctattgatgaatttatccaggatatccttactatagaagaaatctactgtagaaatattaaagatttgaaattataaaagggaggcacattatgattattcttacaaaggaaaatattctttcttacataaaagagcatgtgccttccctgcagttaaaagagccggttaaagtttctatgattggagaaggcgacctcggtgaagacgtggaaggtgacggttattgtaactacgttttccgtgtcagtgatgccgatggatattcttatattgtaaagcagtctacggagcacttaaagcgccgtgggcgcgccctaacccctactcgtaaccgcttcgagtatgaaatcatggaacttcgtgcaaagatcgttcctcagtacgttccggcgctgtatcttggtgacccggagaataatgtatttattatggaagatgtatcaaacctgaagttaatccgcttccagatgaataaaaatcatcttttcccggaactggcaaaacagggcgcacaatatcttgctgccacacatttttatacttcagaattctatcttccaacagaagaataccgcaagctgctcgctcatttcatgaatgcagaactgcgtgttgttatggaggacggtattttccttcatatttttggctccgaccattacgatgcggcctgcggcccggaatttgaagaatactgcaagtcgattcgttttgacccaaaccttgaattccagagatataaactgcgtcacctctttatgagcaagtcagaaacactgattcatggcgatttccatacctctaatatctttgcagatgatacacatttgaaagttattgatatggaatatactttcggcgcaccattctcttatgacctcggattcatcatcgccaatattatttcccaggcctgctccgcagcgttccgtccatttgatacggaaacccaccggaagaactatgtcgcttacctcatctctcttatcgagatgctgtatacctactatattcagtttttctttgaatactgggaaaaagatgcgaagcttgaatataagattacaaatggctataaagaaagcctggcacttgatattttacgagaatgctttgggttcgctgcctgcgtgaacttcagcagagtatgtggtgatatggatacggcagattttgactgtatcaaagataatgagcttcgaacgaaagcgaagtttgcttctgctacgattgataagatgctgtttgaaaaatgggattcttataatgatattaaagaagtcattgaagatattataaacatgatttgttagattaatagcttatttcaatagctaaacagacgcactcaaagaaagaagataccctatatctgtgactctatcactgcgggttgaatgttcgctctagagcgtgtttgaaaaatgctttctgtaagatgtgcgtcgcaatttgcgggagatttcgcctgaatgagggcggcgtagcgggctacgtcaactgaatgaaggcaaaatataccgtaaattgaggcgtgcaggttgtaggaatgatttttcaaacatgctctaaggtcacagatatagggtatcttctttctttgggagctgactttggtaaaatataattcattaagtaatacctaatctttgatttttatttgaaattttacttccattactggctacaatacatccacctgattttgtaagccatatttttgttgcattcggtgttggttttcccttagttacatgaacatgaatcggttcattattttcattagaccaaaaatatactgtatatccacttaccgtgacatcctcccccacctcggcaagtttggttctcgttcgataacactactgtgctaagcataagcgagctatccccgtgtgtcccacggttgtcttatattgtgttaaggtcatgcatttaccagccgcattccctcatttctgatatttaccgccgcatttacatctctgtcatgatgggttccacactgcggacaatcccactctcttatcgcaagatttttcgtttttgcatttttgtaaccacaaacagaacaggtctggctgcttgcaaaaaatctatccactctcacaagctttttcccctgttcctccagtttgtatctcaaaaatgttgtgaacattccccagccgttatccgaaacagatttcccaaaatttagcgaccgcgacattgctttcatatccaaatcttctatacatacgcaatcataggcattggctatctgtcttgactgcttatgcagaaagtcttttcgttgattggaaaccttttcgtgaagttttgccaccttaagcctttgcttattgcgattgtttgaacttttctgcattttggaaagcttacgttgttctcttgccaattttttctctgcatttctgtaataccttggataggcaggctccttaccgttgctgtcacgatataattcatgcatggaaaaatccagccctaaaaacttttgcagttccttttcctgtacttgatcttcatactcaaaaagaatacttgcatagtattttccgcttggtgcctgacttactgttacagattttagtttatattcacttggaacagacctgtgctgttttaagcggacttgtccaatcttaggtaatctcaaatatccattagacagagttatgttcccattgatgcagaccgtggaatagctgtttttattccgcttttttgatttgaaccttgggaaacctgttttcggctgtttgaaaaagttctgaaatgccgtatcaagatgcctgagtgattgttgtaatgcgatactgtctatttcctttaaaaatctgtattcttccgttttcttcattgcagccatttcttttgcacaaatagtatatgttacgttagtcttgttctcctcatactggcgaatctttctatcaagccaatgattgtataccattctcacacagccaaaagtcttagcaaacaaaatcttctgttcatcattcgggtatattctgaatttatatgctctgtttgccaccatgccacttccttttcctcgaaaacctacctgtgatacttgaacacaagcgcaagatgatagtatagtaagaatactaaatgtacgttattatctcaattttttattatccgactaaagatactatactataattaggaggctctatcaagcaggtagcagacgcaattcatctcccaccttagaggtggtcggagtcttcttgctgtaagaggataaatagtttaagcaatttgaatccctccattttcagcatatttgtataacaaatgtgcattactgtgtaaaagttcttcaaacatctctatttcttcatcagaatatcccattctttctgtccatttataatctggtaattcgcatcttgcagaatcaaatccattttctgttggacgttcaaaatttactattactttcttcattccatctttttcaataatctgagaatgaacaatttctgtttcatctgctaatgtcatatatggatacatcataatttttcacctcatttcatagccttgaatcatcgtatacaattattatactacaaaatattaaatatttactatattaattcaaacaaaatccatccacagcacagaatccaagaaaccaaatcctctatatttgtggcctgggagcaagtgttggatgcgagcgcataaacgaacattcaacacgccgcgacgaaagtcacaaatatagaggatttggtttcttggattcgtctgttagttggttaatgaattaaatagtaacttgaatattatttaatcttcacactctttaccttactccatttaccatagtacgttttagaacctgacttggtatacgggcgcattcgtacataatattttttcttactctttaatggacgaacttttgtcttggtaactttttgtttaaatttacgttctatcgttccttttttaaaattgctctttgcacaaaactgtacttgatagccagtcactttccttaacttcttccaggtaatcgcaagagtgctctttgctggtgacttcacagatttcagggaacctgtcattttttctactggcagaagagcgcgtttggttggtttcttggatgcggtagttttgttggatggcttggtatttgctgtggtattgtttttattgttgttggtattattgctattattatttcctgtggtgttattggagctgctattattaccagtgtttccagaggatgtattatcttgatatactctagcaggggcaggcgtttcatttattgttccatcagagcacacagttcctgcataggaataaaggttggaggaagaaatcttcaaatacaaagcagggcgaatagcttcaatactatctatactactgccacctgttctactccttccatcataatctattttaagtgcagccttactacttccacctggcgaacggagccaccaatttacattttctgcatattttgtttctacaaatttataacatcccattgcaaaggcatattctgcacatttactttgtcttgcttcatcatctatactatgatccattataaaaccgtatttttttgcatccaaaccacaaatttgcgtttctgctagcaaaaaaattttatctaaagtattatttccaccagaagtattataagtagcgttgtttttatttgctatgtttctcggtagtatcactgcttgctcacttagaaaaaaagcctcattcaaaaaatttcctttcctataatttattccttcttgattatttatagtatcctgtgcattcaaccaacttcttatactgcttttttcccaagtaatatcctcactattttgattatatcgctgactatctaaggcttgatctgccaatagcaatgcccctccattacttacatttaaaactctccatttaattgcctcatatttaaaataatgataagtagaataatcctcaatccaatcataataatttaaaacacgtttagtattataatatgtcgcatcttccccctttaatctccgatacttgttcccatctattacaatatcattattctcatcccagcctgtcgcattttttaatttattataaatatctccgcttgtcacttcactttgtgggtatgctccaaaccatacacaatcccatgtcactttctgtttagcgttcatagacgaatctgctacagttctcggattgtttaatggtgtaacggcctgtactttatttaaattatttcctgatccaattggaaacaatccgaataaaagagttaatactaacaatgatgctagtcttgctactttccccatttttttcattcgttttcctctccttactttttaatttcccatctatttctctgcattacaatgatgtcctgatgaagtttctgatacaaaaaacatagcattttatagggatattttcaataggttttaccaaaacaaaaacaactctatcctatattcaaaaactccagccaaaaacagcccgagaagagaaccgataccctgtatttgtggcctcggagtaaggtttagatgcgagcgctttaagcgagcatttaaaccgcagcgactaaagtcacaaatatagggtatcggttctcttcccgggcgtctgtctctggggtgtctgccttcaggaaatttgtctttgaatcatccgtcttcggcagcatcgtctttaataaattaaacacgctctaaaaagaaaatacgttaaattttgatgtttttgtcttgaattcaagactatctttttcgattctgtaagaatctaaataacagtaggtttctcctgctttcgaagctgcgctgtcatggaaacgtacatcactatctactttaactgtcatattccaggatggttctgtgattcctctgcagttatagaatacatcaaagattacagttccgatgtcttctctgatatctttgaaagagaatgatggttctgccattccttctaatccgttcatgcggcacattccgatgaagtttaagatgttctttttgttcgcttctgtgattggaatatatgtttttcccattttgcttttactcctgtccttctatatttttgttatatatctgtttatattttttcacattatttttgttttgtctatattaaatttcaagaatgcccggcattcttgctgcgaccaactctgtatttattcagaactaattctatagatatttaaattaattcacaagatacccttgtgatacttactttataatcctcttttttatcttgcctatattaaaattagaacttcttttttcttggcactacttccttttatagccgaaaaaggctgcccgcccacgggaatctttccctcctggccctgtgtggctgaggcgaaagcccgattctatgcggacaacctttctatatacttaagttgattataactactataattaactatccatgatgtgagggcttattacttcaataaactttcaacaatctgtggatgtggacgtggaataattgaagtagatgttacttctccactgattcctaattttgcaagacatgcattaactgctgatcttacagaggatacttctcctgtgattactaagtatcctttaccgcctaaacctctggcaattcttaagtcaacgatgctgactttggaagcctttactgctgtatcggctgcaataattgctgttaaagcggaaattgtctcaattgcgccaactgcctggatctgctgagttggagttactccagcaatggctgggagaacttcttcacgaatattgtcaaggatatgtgtgtcgattaagtaaattccgcttacgagttcagctttgctcatagcagcttttacaggacctacatgtccgccaacaataattacatatttaccaggacaaattggtgtagacagtaataattctacattacctgctttaaccatttcatctgctgtctggataccaacaggaatgcttttaatttctacgaatccaactgcttttctcactgtgtaaacaccatcctttatttttcgattgagatacaaccgtcagcgattgctttgactgtaccgctgatactagcatgaatacaagcacctaatttaccttctgcaggctgagcgatcacatcgccctttgcaacggtatcaccaacacttacacacggaactgcaggtgcgccgatgtgctgtcctacaggaatagatacgtgatctatctctgttgttaattctgtcagaggagctgcaacgttgtattttgtcagtcccagacgagcgattaacttcttgatagggaatcgtttgtactctctcattggatgtactgattctggctggttatgcaatgtactcttaataccctgttttgccatgatacctttcagttcatgatttactttccaaggctggaggttcatgatacatgcatactggcaaagacggcattctgaacataagaatgcgatcattggtgtatcagaaccatcgcataagcttccgtagcttgcaaatctgatagtcttgtttggttcaattctatgtccgatcagatgacgaggacatacttctgaacacatactacagtgacaacatgcagcttttgccatatgaagcatcttaggtattggaagttttacatcctgaatcaatggatggtcttccggtaacacgattaagccttttgttgtttttgtaatcttagaatctaacgcaacatgtttacccatcataggaccgccgttaattacgacatatggtccgtttacggtaactcctccagcgaggtctaatgcttcttttactgtcataccaagtggtaattttaaagtaatgtggttctttacttcaccagcaaatgttacataagaatctgtaactggtttgtcttcaaagtaagcattgtaaatattaagcatggtctctacattggaaacgataacgccacactgtagaggaattccaccttctggtacaattcttcccgtaacttcgtatactgtaatctgttcatcaccagccggatagaagtttggaaggagatgaaggctaatgccttcatactctcccaagagctggttaaagctgttaattgctgcttcatagtgaccttttaaggcaattacacccttgtctgcacctactgcttccatgcagagctttaatgcatcaagaattttctttgtctcaacggccataagctgctgatcgactcttaataaaggttcgcactcagcaccattaatgatgacatattcagccttagcattcatttttacatgagtaggaaaacctgcaccaccggcaccaacgataccggattttgcaatgatatcaataaggtttttttccatttaactcacctcttaattatttcattctgatatggagaccgtcctgtaatacacatcttctcttacggcagaatgatttagcagatgttaaaccttcacctgtaggtccggcaattgtgaatgttgtatatcccattccgccaacaccgatacctgcataagatgggccattctttacgaaaatagttgtttcgatttcttttgccatctttgtaagtttatctacattcttagaatgcatcatagctgtatgtctgttaccatgttctacttctacagcgaagtcgatagcttcgtctacgttaggaacacgaacgataggaaggataggcatcattaactcgatctgtacgaatggatgatccttaggagcttccatgatgatacatttaacttctggtccaaccttgattccaactttgtcaaggatgtactgtgcgctcttacctacgaagttaacagctggtttctttctgtcttttgttacgagatcaaccatcttttcgatgatttcaggatcttttacttcgtatgcgccattgttcttcatgttgaagattaagtagtcagcgatctgatctacagcgataacttctttctctgcgatacatggaaggttgttatcgaaagaacatccgttaacgatatccttagctgctttttcgatatcagctgtctcatctactactactggagggttaccagcaccagctccgatagctttcttacctgttgacataactgctttaacgattccaggaccacctgtagcaacaagcatacgaacctttggatggttcatcatgatatttgtgttttcgatagatggttctttaacagttacgattaagtttctaggagcgcccagctcttctaatttagcgttcagttttttgattaaccagatggaaacgccttttgaacgtggatgtgggctgaatactacagtgtttccaccagcaagcattgcgatggagttacagataactgtttctgtagggtttgttgtaggagcgatagcaccaattacaccgaatggacagtactcaactaatgtaagtccgtcatcacctgataaagcttctgttgttaaatcttcaacacctggagatttaactgctgctaaacggtttttgattactttatattcataagcacccattccgctttcttctacagcgagtttactcatgtactcaagattttcttttgtacaaacaacttctctgataccttcaacgtatctctgtctgtcagccatggaatggttcatatattctttctgagcttttgcggaagcttcaattgcctcgtccatagtatcaaagataccatatccatattcgctttcgcttgagccagtctcaacatcgtttaatacttttttaacgactttttcaattaattcaacatcgatattcattatgcttttcctccttgcattttttctaatgcgtatgtcgctactgccatatcctcttcagcggttccaccacttactccgatggctccaattactttgccatctttcttaattggatatccgcctccaaaacaaataattctgccatcaccagaattatgaagactccacaggctctcacctggttttgtcacatcagcaagatcacatgtcggacactttaaagcacaggcagtgtatgctttatcctgagacacctttgtactgatcaaaagggttccttccatgcgctggaagtacagtaagttgccaccttcatctactgcggaaaatgcaacaggaacaccaatctcttttgccttttcttctatgaatccagccatctttttcaaggtttcaattgacatatccatgctgtcttcttcctttcccatagctcctaaggttttcactacctgtcgtactgtgtcttttaattcttcgatctcctgattttttgctcttgcctcttcgagacgagccattgcaaagcacgcatctgataagcgattgatatatttgcgtaactcctcacgaacaggaacctgctttgcgagtgctgtaattattctctctgcacgtcttacaacagttcttgcaacgtgtaaggctgcggaggaaggattaactccaggtactacgaattctcgcatcagcccgttcacttcggtggatttgtcaatgatattttcgaggtatttgatatcagcttccccgatcttatctttaagcatttccattcctcttgcatcactggctaattcagcacctgcctggaacatcctcttctgaatatgattaatatattcttttatttccggtgagtcagtcagggtataggcaactcccagagaagagattgcttcatcgacagttccgtaagcatcaacgtttaaactgtctttgtcaactctggaaccaccatagagacccgtcgttcctttatcacctgtctttgtataaatattggacattatattcacacccttaacactgtgatatctctacggtatcgacaatgccgataatcgcagcatctactggcaggtcagtctttttaccatttgacatacgtgcggaacttccgcctacgacaattacggtttctccatcgccggctccaacagtatcaacagcaatttctgtctgtttctttgctgtaagatcctgattaatcttctcaacaataagaaacttactgccggtcaggcttggagtcttaatagtcgaaactactgtaccaatcactttacctaaatacatgtcttcacctacttactcttttacaatcgtaattccgcgatttaaagcttcatcttttgcaagaccggtaactaatgcatcctgtcttacaacgattgtcttaaatctcgcattctttgctatatcgactctgccgattacttttttgtctaactttacactgctcggtgtttccacttttttgactggctggcttactgactgtactgctggctccatctttgtggaaacaattctgtctttcttcggtgccggcttactgttatccagtgccgggagagacacctttgcagagaaaacttcatttactttactgcacagactatagtctgtagtcaatgtgattccgtatgcgagcatatcttcaagattatgtcgcattttcgctttataagcttctgttactttaaagcctaactgctctcttaccttgttatccggacagcagccatcaattgctgccacgattggctttcctgtagccatcgctctggaaatcatattggtaagaagattatcactgatacaatttgcaacctttgcggctgtattaattgtcagcgacggaataattacaaactgactgtcatctacaatctgtctgccgttaaccggagcgccttcaacataaatggcatccggaccaatatcattcctgatacgttcttctgtaattacttctcctgctgcctttgacagtactgctgtcaatgtccagccatccttttttagttcatttaaagatgttactgcatctttataaccaattaaggctccggagaaaagaacagtagctttcttacaagcctgtgcgtatcgtaagatgacctggtctgaaatatattccacaatcgttgccataagcgcatcttcaaattcttttctattcatcatgccacctattgcttattgcagttcatggcaattcctaatggagtaaccagtaaaggttctttcggcttaatcgtcttaacccctgtttccttctcaaaaacactttcgaacttcttaaagctgcaggcaccgcctactacataaataacgtccacatcgtatccttcgataaaacgggcaacgattgctgccatcttttcaattaccggtttaaccacaggaaataccagcatttcctgtttcggatcttttttgattctctcggcctcttcaaaggaacatccaaggctcccagcaagtaccagagtcatgtgtgttccacctgtaggctcatctgcggtaaagataacctttccgtctttgagaatactgataccggttgttccaccaccgacatccacgactgctccgtccgtaataccaagaacagaagcggctgctgtaggctcgtcaatgacattgactacatccagtccaacagactcgactacgttggaaattacctttacgtttccagaaataattcccggcggaatggctgtggcagcttcgtaaaactccactcccatcagatcttccagcttggctttcatatttctgaccgctctggatgcacccatgaaatccacaacgattccatcccgtacaaccgtggacggataggaagccccggcaattggtgtgttgttggaatctacaacagatactacaatgttggcggttccaagatcgacacccaatctcaaatccccttcatagggacgaaattcttcatttttgataagctccgaaaatccaactaaaacgttattgtaatcgttcatgtgatccccttatttattctaatgttcgaataccgaatcattattgtcaggattgcatgtgtctgtctcggtatccacatgcatccattgcgcatatttgtatgtactaaatgtacgttattattgatactatcgcaggaaaggctgaaggcctttcctgcctgattactgatttataatccagagccgattattccgacttatttgttatcgttattatcggtgttcttttttcttctggatctgcttcttctatttcctgttgaagtctttcccttaggagcgtctgcctttttgtcagtttcctttttcggttcagtcttttcagattttgcttcctctgcttctgctttctctactggagtctcttctgctggagcttctggtgcaggttcttctgcttttggctcttctacaggagcttcttccactggagtctcttctacaggagtttcctcagcaggttcttctgctttcggttcctctacaggagcttcctctttgacctcttccgtttcaggttcctctgatgttggctcttcttcctcaggttcttccactacaggcggttcaggtgcttcctcggtcactacctcagcctttggttcagtttttggtttccagttctttacgagtaccggtttctttgtatctccttttggacgataaccttctgcaagagcaatttctcctccaacagtctctctgttgtctacgagtaattctctcatgccatctgccggtcttgcttttaacagtgtactctttgttccacttaaagaaccgttaactgcttctgccgcttttttgcctgctgcgattgctgctctacatgctccgacgttaccttctacctttacagtacacattccgccgccctttgcatattcatatccaagcagttttacgttagcagactttactgctgcatctgctgctgccacacaggcagctaaaccaaaggtttcgatgaaaccaagacatttattgttagacaccttcacacctcctcacatttcagaattaattaattgtaaagccttaatccagaactttgaatggcattttctttaccagtcttgcggcattcgcgccaatcttccggaacagctctgtctgatataacttaatcttaaaaagaggggccgctttatccagcttctcatgctgaagaacaatgccttctttgctgataccaacgcccacccctaatcttgaattcaagctggcattatgtgcaagttctaatacggaactgcaatgctctgcctgaacatcataggggatgccttcctcctcgattccaagaaggacgctgacaaaatcagcttcagaaaggtgatcacagtcataaaaaactttcactgaaggtctgttatcaattactgtattgcttccttccataattgtctcctatacatcagcacaagacatcgcaagtcctgttgctaccgcattacgaggaccttcgcatccgcgaatgtttccccgaccagctactatattatattgtgataatgcatcagttacgagagtcggcacctcgaagtcgagtgcagaaccacctactaatactacaaattcgatgtctcgtacattaccggtaggactaaccttcgccaatgaacgaatcgcatttgttacgaatacctttttctttgcattggttcttaccatcttaatcttttccatggaatcctgtccctcaagcggaactaactctccatcttccttgactaagacaacctttgcgaatacattcggatctaatggctgttcaaagaactgtacggttccatcttcatgacgaatatggaaaagactttcaacctttgcgagagaatactttttaatatcttctgctgtattgaaatcttccagtccaagttcggactgaatcagtaaagttaccatgtttccggcccccgccagatgcacgagctttacattgccgtctctgtctttaattgaagcatccgttgatcctgctcccatatctactatggcgagtggtacatttgtacccggtgtagttaaagctcctttaatagccatatctgcctcaacaccgccaacatatacagggatttttaatcggtctgtcaattcttccgcgatcatcttcatctgaagacggtctgccttaaccatggcagcaattcctactgcactttctaaagaaaattcatttgcgagaccacctttaatcttctgaggattataagtatctacagcaagtaaatcctgaattttgatatcttttggatgctggtttgtaagatttgacataacctgacgaactttttcaagcataccgccggcattggtgccaggttcacctttaatatcttcgatgactggaacgctatttacagcttccatcatcttctcggctccctcttctacgccaacgattacttttttctttgcgcctataatctcaatagaaccggcagggatacgtctttcttttacgtctccttccggtgttttaatgacaacggcagaacgatttccgattaacgcgcgggcaatcggtacaacctgttttgtatcttccggggacagtttgaataatgttgcgataccatatgggttagagagtacttcgacaactccgccaacaggtgcaacttctactgcacataacattccgagaggtactttatcaatcatacctacctcatcaacgataggaatcttcttttcaagcctgttgttaatcaaaacgccatcatcgcgctggacaatggcacctgtaatgttaaatattttgttatatcggttaatgagtgcagcggcagcttcaaaggaaacttctgccggaataaccacaattacatctccgccatctttgacagtatctaatctgtcgatgcgctgagatattccaacaccaatcccaacaccccctggagtattgggattgtgtccaatcatagtagattccgtgataatagtttcggtaatagtctccatagcgacatcaccgataacgggagcggcttcattaatacgaacttcatcaagatcactgatttcaaaaccaacttcatcaagggcattcttcagtgactgaaaaactccgtgtatgttctgtttcgttcctttaattccagtagtacctgtaataccactcgaaaggaatgtcacatttttaccatcgattctggcaatcgcagtttccgttgttgcattgccaatatcaacgcccgcaactaatttcacttctcatacctccgtcgaaatcaatcaactaattatttttttaaacggttacgtttttcgtaaatgtctgcagcttctttaacgaagttaccacttactgtagcaccgtattcgttgattaactcatcaccgattgcatataattcagcttttgttgaacgatatggtctaagagcgttataaatctcaagaagtcttgcatcaggtactgggattaattcaccagctcttcttaagttcgttgcgaagaatccacgtcctgcagattcagcaacctgagcctgtaattccagagtttcttttgtgatacggaaatcttttgcatctaactttccatcaataactccctgtaaagttaaatcatttaaagattttccagaagcactcttgattaattctggttttttctctcccagtgggtaatcctcaaccgtaaccttgctttcacattcgcaggctgcggcagaaccctgcatgtttttcataacttcctgcataatctgtcttactaataattcctgatccacgattgacacctccgtctatttaaatacaactttaagagctttaggagccttatctctgtctgcatgctctgtctctttgatatgcagtacagcggataaagcctggaatttcggtcttgccatctggtcattctttacaggtaccggatttggtgattctcctttagcgtactgagcagcgtttttaccgattgctctgtatgtttcaaggtcgatcagtgggcactgtgggaataactctaagttagacagcggtggaaggtctttctgatggattacagtagtacctttggactgaattccaattccgatgcctgaacctgataattcagcagcatcatgagcgatgaaagatacatcggatgttctgtaaactttaacgattctacaggaaacaccttcttcttccagaccagccataacctcttttacaatatctgcatgaggaatacctacgatatttgttgtctgagattctccaaaagcaggagctaaacctaaaacaacttcgttaggatttgtgcctttttctgcatcaccgatttcagtaatctgcattccagggcactcataagtttctccctctacagcagaagctgcggaagtatctgcagtattcatttctttaagaacttcagcgataacactttttaataatttttcatcaattgccattatggttcaccttccttactcgattaaagcttagccggatctactgcagtacggatatcagaaatcttctcccaaagttctgggctgatctggtaacctgtcataggtccttcatagcagttagggctgttaacagcagaaattacatggaatttatcatcaagcatggaagctgtatgtaagtagtcaccaacaactttagctttctgaatgttgaagatagactcagcaacgtcttcaaatccacccttgtaaagagctttaacgaagtcgatacctgtaactccacgatcaagcatatctgtagcagctttaaggtcagctacaacgtcacggtcaggcatatcctgtgaaccacgagcgtatgtggcagcttcaacttcttcgtctgtaatttcaggtaaacctaattcacggaacagtgcctgaatagcttttgcagctttattacgtgctgcaacaacttcttcttctcttgcaggaagaagaccagcatcaactcttaagtcacgctgaattacgcaccaatcatcataatcgtctgcatcccagttggatcctgcgaacatgttatcatagttcggtgtggatgaatatccggaacagatgtagtcagttcctggaataaactgtggaatagaacgagcaactctacgaagatcagagtgtgtaaatgactggtcattagaggaagcgttctcaaggtcaagcatagcggcaattaagttctcacatgcaacggcgcggataccaccaggtacagcggcaggtacaccgatacaggatacagaaccattctgtgttccctgaacaccagcaccacgagtaacaccgaggcatctagcctcaaggtaaagcatagactttccttctgccatacccatctgaacctctgaaccagtaccagatgtaaatctcatcttaacaccacgagatgcgtagcaggatgctaagaaagcttttgaccaaggagtatcatcaccatccatgaatacgtcttcagttccgtatacggatactgtctcggcgtaagcggtgtaacctctcatacctaagtcaagctctgtagcttcttctacagcacactgtgtaaggataccaggacgtccaacgttagcacctaacataatagcgatagcattaaatggagcataacgtacaatacctactgttgtctccatctctgcaaatccacgtacagcagcttctgctgcatctgctgcgatctgaaccatgttatcctttacgtttgtaacgtggcactggttagctggttttaaacgacatctcatcttggtaatacccatcatagcttcaagtacgctgaggttaccaacgatttctactaacttagcaggtgtaactgctgtagtatattttaagcactcctgtctgttaacattaatgtcaactaacatacgcgcaatctccagagagtctgtagccattgcttcttctgcaaagtcaagattaatggcatatcttgcgatgaatgcgtcaagcatgtcgaattcatcttttgtttttccatccatttcaacaacttcgccgttgacgatcttgatagatggagttgggtcgaatgggctgttcatggcaataaagcctacttctggccattcctttgcataaccatcctgattaacaggtctttgatctaaatactcaaaacgtttacttctcacggtctcaacacctctcaaattccaattagactatcttttaccttcaatatatatattcaaaataaaagtattacaatatccaactgcaggctctcacccccgctttgtggatatctcttactctaattccctatatggctctcaccccatataaagaactttaaaaatcagattgttaatcttagatatatggaactgtaccggattccagtggttcgtttggctctaaagctttaagtaactgcttaccaacttctcttgcaccaatgatagcctgtctaactgctcctgaatctcctgtgaagaagaagttaacctcgttagagaaggatgttccaccattaccaggtgtagcgatagaaataggatcgattgtagctgtcttagaagctgtatcggctaatacgataccaatacctgaaggagctcctacagtgataccaaatgctttaccaacaactgcgccgaatgctttctctaagcagtaagaagcacgtgctgtgtactggaactcaagatgtccagcggagtttccgtatacatcaccaaagtgttttccaacgaagcttaatgcaacttctacagctcttctagcatcggatacgtcttctgcaccaaatacaactaagcatccatgtccagcgccgccttctgtatcacgtgggcactcgattaagcaaacttctgtgtttgtagctttaacagcttcatcacaagcgaagatctgaggacctgcacctgtacggtctgcgatgataccgattgaacggtacttaggatcaatctttaataattcatgaacactgtagtcaaggttagcgattactaaaccaattgtatgtcccattgctgttccaacatactctgttaaaccgcaaaggtcttcattgattccctgaggagcttcgcaagccatgctctgtgcaggagcttctgtgccacccatctttttcataacttcgtccatgattttagccatcatttcatctttcattgaattatacctccattaataattgatcagacaaggactaactctattgtggtaagatcttttctacgtctgtatgtggtcttgggattacgtggctggaaactactgtaccaactttatctgcagcaactgtacctgcgtctacagatgccttaacagctcctacgtcacctcttaccataactgtaactaaaccggaaccgatcttttcgtatcctactaatgttacgtttgctgatttaaccatggcatcggctgcttcgattgcgccaactaaacctttggtttcaatcattcctaaagcttctttctgcataattgacctccttataaaattcttatctgccctgtggttgatttgttcaggcagaatatattttggttgatttacaggatagtatcattatatagcaattttcacaaaattacttggctagtgcctataaattttagcttttaaacacatataaactcatgtatttatttattttcatgatactttgttgccatttttaccacagggtagcaaatgattctgtatacaaacgctactattttgcaatatgatcaagaattttattaatatcttctgctgtaacctttctagggttagcctgtgtacatgcatcagccaatgcacgacgcacaatttcttctctgtgtttattaaattcttctacactgacgccacattcggacatacactgtggacgatccatatattttaacagacgctggatctctgcaatcagattagccacaccaactttaggtgtaggagctggcaggccaacgattcttgccatcttctgatacttctttgctgcgtcattgctgtgttttgcgccttctcttgccatatcggcattaaattcaataacataaggaagcactaacgcattggctcttccgtgtggaatgtggaagatagctcctaaagcatgggcaataccgtggtttacaccaagatttacaaggttaaatgccatacctgcaagacaggatgctctgtgcatcttatctcttgccttaatatcataaccattgcggtaagcgcgtggaagaaattcaaaagcaagctctgcagctttctctgctaaacagtcagagcaatcgctcgctgtctcagaaacataagcctcaagagcgtgggtaataacatccattcctgtatccgctgtaataaacggcggcgctgacttaacaagttccggatcaaggatagcaatatcaggcataaggctctcatcgatcaatggaatcttaacccccgtcttactgtctgttactacagcaaactgtgtaacttcggaacctgtaccacttgttgtcggcagggcaatcagtttgatcttcttctgattatcaggattctgcttctcttcaatcttcttagccatatatacaatagctttcgccgcgtcaatggaagaacctcctccaagagcaactacgatatcacagtccttatcctgcaaaaatgcgatacccctttcaatcagatccattggtggatcagggactacttcgctgaaaacggaaacttctttgcaattagacaatttttttaaaatcatgtctgccattcctgaatctaccatgaacttgtcagtaatcagaaccgcattctcgtctttttcttcaagaagtgcgtcgatggcatcctcactgaataaaacttcagtggaaagtttaaaccgtttcattttcctcctcctttctgtttctgtacttttctctatactcagatggcgttaatccagtcttctttttgaaggccttactgaagtaattcgcttcattgtacgccagatccaaggcaatattaagcaccggaatatctgtgttgaccagcatttcttttgccaggtccatcttccggtctgtcacataggtgatgaaattcacacccatttcttttttgaatatcttacttaaataataagtactgatattcacatggtttgcaacatcctctaaactgatacccttctttaagtttctctctatgtaatcaataacggccttcataccgccttctgaaagcttacctttgatattcatcttatcaaagagaatgtctaccatcttgataatttcattataggcatcatgcttattattatagagaagatacttaatcttaagcttctccatctgaactacaagttcgttcgtatctgtgattccaagttcctcactaatacgcacaactgcctttgcaacctcctgtagtctctttgatataatattaacatcatgctcctctaagtataactggtctatgtactctcttaaaatgtctacagaagctttgtaagagcatttttttaattccatttcgaactttgaaagcaatttattactctttccggtctgtcgtccctctcctaaacggcttgcaaatgacttcacggactcaagtaaaacctcttttctgataggtttgagcaggaaatcatcaaccttcaactttattgctctgtgtgcaatattaaaatcatcatatgccgttgttataataataacagcctttggaagttttttccttgcatatttgataacttccataccatccattccaggtatgttaatatctaccagcatgagattgatatcttttgaatcaatcatctctactgcctcgaagccgcttttcgcttctccgacaatttctacatccagaagattctcctcaagaaaaatcttcatggaggttctttctaattcttcatcctcaacaattaatatcttatacaagtcaactctgcctttctattcctgtaccaatggcacttttattgtcaccttcgttccaagagaaggtttattttcactttcaatggataacgcatattcatttccaaaataatgaatcagtcgggaattgatattataaagtcctacagatcccttttcattatctttatacgcatccccgcgtaaaacgctgactatttttgactgggacatgccatcaccattatcaataatgtcaatgcataaatctccatctttctcgattccattcacttcgaccattccaccggatgccttattctcaactgcatatttaatggaattctccacaagtgttgtcagagataaaaacggaagcttcacactgtaatatgcctccgatatattaatggaatactgcagcctgcttcccaggcgaatcttctgaatcttaagataattctgcacatgggtcagttcctctctgagtgggcttaatggatctctgctctttctcaaaatgtagcgcatcatatccgcaaacgcatagacaacatcctccgtcatcttcgcattctcaaagaaagcaagtcttcctattgtattcaatacattaaaaagaaaatgcggattgatctgataatgtaaagctttcaactcaatatcacgaagagacttctccatctcaatacgaagcttctcttccttcatgagcttataatccttttcgcgaagctctgcatttaccttattcgcatattctctctccacagaataattatagctgtcacagataatctgtgccacagcctcaatcttctccacagacacctcttttacctggctgtagagctcaaccagttcctgattgtccttccaatcctcgctttgtgtcgtaatcttctttaaatctgcaaaatctgtgctggtaacctgacctgccagaaacgctccaacatactgtccctttatcataatcggaatcgcaaaatcaattagcccagcatgacatatgtacacataagctttcccaattcttcttgcctttcgtcctccacaggcatcacagtaatagcacttttcacgaaatgcatccagttcacgaagacgcttgcaaaaaggtgtaaaattactctgctttgtaatcggagttccgttgcaatccaccgtcacaaatgccagatctgtagccttcgcccaattatcctgtaaagtttgaagttcttttacatccaccacgtcttcaatataaatattattcttttccgtcaatcttctgtcctccaaacatcggcattatcccaacctcatcggtcagaaattaatggtttttcttccttctatcttttttattcaaatagcggcaggccttctctgcacaattacaggcatcttccgtataacagtctgcaccgattgcctttgcctgcctctccgtcagaaaataaccacctaccataaaataaaactgatcccggatacctttcatctcaaattcttcaacaacagctctcatatcttcttcagaatgcggcatgataccacttaaacatacaatctgagcatgactgcctactgcctcctccagaaatcttctcggtgaaacatccacgcccagatcaataacccttatattcttactctccatcataatcttaacaagattctttccgatgtcatgtaagtccccttttactgttcctattataactgtcccaatctcctttttggcacgtccgccactgtaatggcgcagagtagaaacgcccctttccaatgcgcgggtaacgctcaaaatttctggcacaccaacttcttctttacgaaacttgtccgctacctgttccattccggctaaaaagccatcttccagaatcatctgcgggtctgttccctcttctaaagccatcttgaccaagtctgagactcttttcccctgtccccttttcagggaatcaataatttcatctattgttgctcccattttgccctccaaaaatctatcagagtgttctatggctttattttatactttttacacctaaaaagcaaattattatcgtatattttgcaaattacttttcttaaatataaaattttactaatttacagcccaaaatgataaattattttattcaaacgggcaagaaaaaaggtaaaaaaaggaattgggtgaaccaataacaattttttctgatttgggcttgcaaaaaacagatgaaacctgtacaccagctccttcaccgccaaccgtcactccgtagaatccccaaattcttccataactctgtactcccaacttcatccccttcactcccaactggtattctgggaaatcctgaattctcctgattctaactaaatctcgccaaaaaacagaaccccaagatagaatagaaccgatatctgtgacctcggagcaaggtttgaacgcgagtgcataagcgagcattcaaaccgccgcgactaaagtcacagatatcggttctattctatcttggggttcgtctatttcttcgactatttatttgcgaattacagagtcactttctccagatgccacatctcttttgcgtactcttcgatcgtacggtcagatgagaacttacctgcggatgctgtctggagcattgctgttcttgcccagtgttcttcatcgcggtaagcagcatcgattctgttatgagcttctttgtaagaatcgaagtctaacagtgtgaaataagtgtctttttcaaggagtgcgtcatagagggcacggaacagttccggattctctggtgaatagaatccatttactaactgtgtaagtacctgacgaacgtcctggttgttattatatacgtctcttggattgtagtttccgtttttctcatattccattacctggtctgcagataaaccgaagatgaaagcgttttctttgccaacttcttctacaatctcaacattagctccatccattgttcctaatgtgagagcaccgtttaacatgaacttcatgttacctgttcctgatgcttccttagaagctgtggaaatctgctcgctgacatcggctgctgcaaagataagctctgcgttagatacgcggtaatcttcgatgaatacaactttgatctttccattgatggatgggtcgttgttaatcttatctgctactgcattgattaacttgatcgtaagcttcgctgtgtaataaccagcggctgcttttgctccgaagataaatgttcttggaacgatatccatgtctggatgtgctttgatttcattgtaaagatacattacatgaagaatgttcattaactgacgtttgtactcatgtaatctcttaacctggcagtcaaagatggaacgtgggtctacatcaattccattatgctctttgatgtattttgcaagacgtaccttgttctggtatttgatgttcatgaattcctgctggcacttttcatcatctacatatacttttaaatgtttaagatgatctaagttagtgatccagtcatcaccaatcttgtctgttacccagcttgccagtaatgggttaccatgaagaaggaatcttctctgtgtaataccatttgtcttattgttgaacttctctggcatcatctcatagaaatcttttaactcacgtttcttaaggatgtctgtgtgaaggcgggcaacaccgttaacagagtagcttcctgcgattgcaaggtgagccattcttacctgtccatcatagaggatcgccatcttgcggattttttcctgatctccagggtatttgttctggatctcgataacgaaacgacggttgatttcttctacaatctggtaaactctaggaagtaatctggagaaaagctcgataggccacttctcaagagcttctgccataatagtatggtttgtgtaagcacaggtctttcttgtgatttcccatgcttcatcccactctaaaccttcttcgtcaacgaggattctcattaactcagctacagctactgtaggatgtgtatcatttaactggaatgttactttctcatggaacttacgaatgtcgtcatgtgtttctttgtattttgcaattgctctctgaacagatgcagaaatgaagaaatactgctgttttaaacgaagttccttacctgccatatggttgtcgtttggatataatacttcacagattgttcttgcaagattttcctgttctacagctttctggtactcacctttgtcgaaggaatctaagttgaagttgttgattgcttctgcatcccagatacgaagtgtgtttacgatatggttgccataacctacgattggcatatcgtatggtacggcacgtacactctggtatcccttctgaacgaacttctgtcttccgttatgcatctcaacatctacataaccgccaaacttaacttctacggcatactcatctctcttgatttcaaaaggatttccgtattttaaccagttatctgggacttctacctgataaccgttctcaattttctgtttgaacataccataacggtaacggattccgcagccgtaagctggatatccaagtgttgcaagagaatcaaggaaacaagctgcaagacggccaagaccaccgttaccaagtgctgcatctggctcctggtcttcgatgaggttaaggtcaagtcctaactcctctaatgtttctcttacatcatcatagcaaagaaggttaatcatgttgtttccaagagctctacccataaggaactccatggacatgtagtaaaccatcttcttgtcctgtttttcgtatgctttgtgtgtctcgatccagttgtcaataatatcgtcttttacggagtatgcaacagcctgataaatctgctgtggtgttgcttcttcgagtttacgacgaaacagcatacggacattggactctaactcttttttgaatttttctttgtcgaaagtatcctttttaatcaatgaactgatcctcctaaattatctcgtataatcctggaatctttttcgtgcctgctttcgtgagaagatttctatcagccagcctcagattttgagacgtacgtagtacattcgccgcaaaatctgagtgcctctggtcaaaaaccattcgctaaaaacaagtgtttaaaaggttttaagattacatttttttctcgacacctaatcttactttttctccattaatatcccattccttggaatatccgccttctgcgtctaagcacatatcgtctgccaatacatcattcttgatttcatcagtgtatttggtcatgacttctttaatcttgtcattaccctcttcgtatacagtaatgtggtctgtcacttcaaagccggcttcttttctcattgtctgtaccttactgatgatttctcttacgaatccctcttccaaaagtgccggtgtcagattagtatcaagtactacggtaactccatgatctgcctgagaaacgtatccctctttctgtgacatatcaattaataactcttccggcaataaattgattttaccatcatttaactctattgtcaaaaagccatttgcgtctaattctttcttagccgcacttccgttaaggtttgctaaaatattacggatctttcctaagtctttaccgtattttggtccaagaatacgcatctgaggtttaaatgtgtaatctgtgaggtcagatacatcatccttaaaaataacgtcttttacgttaagctcaccttcgatgatctgtttgtagtaatctgttaaagcagcctctccatttacaaacatctgaccgattggctgacggttcttgattccggatgcgttacgtgcagcacgtccaagtacaacgatgtcaagtacttcacccatatcctgctcaagtttctcatcaatcattgcctcatccactgctgggaaatcacataaatggatactttctggtgcatctgtattaacactctttacaaggttctggtaaatgtcttctgtcataaatggaatcattggtgcagaagctttgatgaatgtaacaagtgcagtataaagagtcatgtatgcattaatcttatcctgctccattcctttagcccagaaacgctgacgggaacgacgtacataccagttactcatatcatctacaaatgcctgtaatgcctttgttgtttcaggaatcttatagttggcaagacagtcatctactgtttttacgcaggagttcagtcttgataataaccatttatccataacagataacttgtcgtactctaagctgtacttcgttgggtcaaattcatcgatatttgcgtaaagtacatagaatgcataagtattccataatgtacccatgaatttacgctgtccctctgttactgcatctgcgtggaaacggtttggcagccaaggtgcactgttagagtagaaataccagcggatagcatctgctccatgctgctctaatgcatcaaacggatctacggcatttcctttactcttactcatcttctgtccgttttcgtcctgtacgtggccgagaacgattacgttcttataaggagctttgttaaataacagtgtggactctgcaagtaaggaatagaaccatcctcttgtctggtctactgcctcagaaatgaactgtgcagggaactgctgctcgaaaagctctttattttcaaatggatagtgatgctgtgcaaatggcattgctcctgagtcaaaccagcagtcgataacttctggcactctcttcattgtctttccacaatctggacatgtcagagtgatcgcatcaatatatggtctgtgaagttctacagtctgagcttctggatttccgctcttttcctctaattcctggcggcttccgatgcactccatctttccgcagccttcacactgccatacgtttaatggtgttccccagtaacggttacgggaaataccccagtcctgaatgttatttaaccagtcaccaaaacggcctttaccgatgctctttggaatccagttgattgtgttattgttgcgaatcaagtcgtcttttactgctgtcatcttgatgaaccaggactctctcgcatagtagatcagcggtgtatcacatctccagcagaaaggataatcatgttcgaacttaggcgcatcgaaaagaaggccttctttatctaagtcaacaagtaccttagggtctgcatcttttacaaataatccagcataaggtgtgtcttctgtcatgctaccctttccatctacgaactgaacaaatggaagatcgtactttcttccaacctgtgcatcgtcctcaccaaatgcaggtgcgatgtgtacaatacctgtaccatcggacattgttacatagtcagcgcatgttacgaaatgtgctttcttatgctgtttttctgcggactttgcagcaccttcatatagtggaacatactctttatattcaaggtctgttcctttgtaagtttcaagaatctcgtaagctggagtttcttctgttccaagcttaccaagaactttatccagtaatgcttttgccatatagtaaacataaccgtcagcagcttttactttacagtaagtctcttctgggtttacacaaagagctacgttacttggaagtgtccaaggtgttgttgtccatgcaaggaaatacgcatcttcaccagccactttgaaacgaacaactgcggaacgctcttttactgccttatatccctgtgctacctcgtgagaagataaaggtgttccacaacgagggcagtaaggtacgatcttaaatcctttataaagaagacctttatcccagatagtctttaatgcccaccattcggactcaataaagttgtcattataagttacatatgggttatccatatcagcccagaaaccaacggtctttgagaaatcttcccacattcctttgtatttccaaacagattctttacactgagtgataaatggatctaaaccatactcttcaatctgctcttttccgtcaaggccaagcttcttctctacttcaagctctactggaagtccgtgagtatcccatccggcctttcttggaaccatgtaacccttcattgtacggtaacgaggaatcatatccttgattacacgagttaaaacgtgtccgatatgaggtttaccattggctgttggtggtccatcatagaaagtgtaaacagggtcaccttctcttgtttcgatacttttcttaaaaatgtcatggtctttccaaaactgtgcagtttctttttctctctctacaaaattgagattcgtggatactttcttgtacacgacgtttcctccttaatttagtcagtttaatttaactacttttagattaaataaatttatattgtgatgttatggccaaaagatattttgcccctaacttgatgtcacgaattactccacagctaactctgctcccataattctgaaacatcatattattatgcccgatgtgcagaccaaattttccggcaaaaaaagaaaagcccccatccccagtaaaaggatgaaagcctgaactatcattataccacctgtacatactgacatatgcttctctgttaacggtgagattccgtcactgcttactgtaacctttcggcagtgcaactcaggagtgatattcggatattctctactgacaacggattcccactatctccgtctcactgaagcgttcaaaaattcttactgtctccatcaacgtttttatcacagataatcatatactaggtgggataaattgtcaacagattttcattctgtatttactgtatttatcactatattgattcctgtactatttatatcagatgtgagatgactcccacatcatagcaagaatgccaggacattcttgaattgataaaatgtcaccagttacttttatacattatttatacaatgagatttcccagtttcacaaaacattgttaatccttaaattttcttttaatttacaaaagattatgctacaatactccttaattagaaaggagcctataatgttaaaaaaactcattgtatcttttctttgtgcgattgttgtcgcctgcacagttctcggcggattttgcctgctttactttactattccaagccagaaagcaaaggcatccatttccctgccttctactgtagaggacagtgaaactgcagcggagtctaccacagaagcagattccaaagataagaatgtttatgtggccgatgtgtatcagtctcttacacttcgttcagaggcaagcgcagattctgacgcgattacagaccttcttcctatgacacatctggaagttcttgagtttgcggcaggtacaaattatgcttacgtcaaggtattaaccggagataaagaaagctataagggctatgtaaacagcgaatatattactaaattaggagaaccaaccgttcgtattgggacagaggagtaaatgaattatgttttctaacaatttaactatgatgaccgacctgtatgagcttacaatgatgcagggatatttcttcgaaggtaacgaagataaggttgtatttgatgttttttaccgcaaaaatccatccggcagtgcttatgccatcacctgtggacttgatcaggtaattgattatataaagaacctgtcattttcttatgaagatattgattatttaagaggtctcggcatttttaaagaagattttctttcctatcttgccggcttccatttcagcggagatatttatgcaatcccagagggaagtgtcgtatttccaaaggagccacttgtaaaggttatcgcccctatcatggaagcacagcttgttgagacagcgattttaaatatcatcaaccaccagagtcttatcgcaacaaaggcttctcgtgttgactatgcggctggcggcggcgttatggaattcggtcttcgccgcgcacagggaccagatgccggaacactcggcgcaagagctgccgttatcggtggatgtaccggaacttccaacgtactcgccggagaactttacggcattcctgtacagggaacacatgcccacagctggattatgagcttcccagacgaacttactgctttccgtacctacgcgaaaatgtatcccgatgcttgcatccttttggtagatacttacgacaccttaaagtctggtgttccacatgccattcaggtatttaaagagatgcgtgatgccggaatcacttctaagcttatgggaatccgtttagacagcggtgacattgcctacctgtctaaaaaggcccgcaagatgttagatgaggcaggatttacaaatgcgattatttccgcttccagcgaccttgatgaatacctgatcaacagtttaaaaacacagggctgtaccgtaacttcctggggtgttggtacaaatcttatcacatcttctgataacccggcattcggtggggtatacaaacttgcagccatcaaaaaacctggcgataaagaattcaccgctaaaattaagatttccgagaacccggaaaagattacaaacccaggtaacaaaacagtttatcgtatttatgataaagaaagcagcaagattaaggctgacttaatctgcctcgttggggaaacatttgacccttcagaagatttaaagatttttgatccgatctctacctggaaaaagtccattcttccagccggcagctatcagatccgcgaaatgctcgttccaatattcttaaacggacagtgcgtatactcctctcctgctgttatggacatcaaagcatactgccaacaggaactgaatacactgtgggatgagaacagaagactgataaatcctcagaccgtatatgtggacctttcacagaaactgttcgatctgaaacacaagttattaggagacgaaaaataaatactaatttgtaaatttagaagagccagaaaaaagaattgttatctgtttgattttgttccgttgcgctaagcattccattctgcccagaaaaacaggaactcgggaaaaacgagtcccaagttcctatggtcagaattccatagcgcaaagtcacaaaatgcaatacgaataacaattctttttttctttaccatagtttccttacaattcagcataaaattttatttcaacggctgtctgtttttaataacaatagcaaagtcgatcataataagaacaatcgttagtatccatgagataggaaaggcataatacagaacacttaattggcaatattccccgaaaatagtatatatccaaataatacgaaaacaacaggttcctataattgcggcaatagccggggataaggaatgtccagtacctcttaatacgcctgccggaatctcataaaaactgcatagtggttcaaaaaagagaatacacataatacgaagatgtgcattttgtataaccgtttgttctgcgaaaaaaaatcctgtaaaaaattttcgaaatataatgagtggctcaataattaccaaactactcaaaacagaaaaaatcatacatatccatataatatagggaaagaattcctgctatataattaatagtcaaaaaagaaaaaacattgtataataaatatatcttaggagtaagtattgtataatattttttagtttatcaaccagaaaatataacacatggaggagggttacatatgacaggctgcaaaaaaattgatatggatacctgggcacgcagggaacattacgaatactatactaaacagttaaaagttgaatataatattaccgctaatgttgatgtaaaaaatgtattggatttttgtcattcaaaaggttacaaattttaccctgctatgatctatcttgttactaagacattaaaccgcatcgataattttaaaatgtttaaagataaatatggatacctttgtgcctgggacaaaatcattccaaattatactatttttcataatgatgaccatactttttctgattgctggacagatttttccgaagattttaatatattttatcaagatatcctaaaagatatggctactgccgcaacgaaaaaaggaattaaagcaaaagaaggacaacctgctaatttttactgcatatcctgcacgccatggacaacctttaccggttatagcagtagggtctctaatggtgaaccttcttttttcccaattgtattgatgggtaagtataagcagcatggcaaaaaaatactgatgcctgttaatatcacaattgctcacgcagtagcagatggttatcatgtgggattattctttcagtatctccaggaagaaattaacaactactaatttgctggggacacagacgccgctttaatagaagatattgagctgaattgtatggagtcttctaaataaaaaagaaataataccatatctcagatgcggcttcggagcgtgtttaagatgcagataagcattttaaacacagcgactacagagcagatgggatatggtattatttcttttttcgtctatccaaaatctacaaattagtattttataatattttattttggataaaacactcaaatatataacttggattttcgtaataaacactactattataatcatctattttgtcactaataaaagaatggtatacttcaataattgcatctactacatctatctttttttctaaagccacttgttttatcaagcgcttatatacttttccgatatcccaatgggaaggaactgcatactgacattcccccacattatcaaaatttccaacggaaatttttgcttcttcaataaaatcatcactcacccgctctatattatcgctatggtaaatatccgctaagtcatatatttttgcaatgcattctttgcctaatgcatctaccactgctgctcttttattctttgtttttctggcaatatagtcaataagtgaacatgtataaaataagtcgttgtctttctgactttctcttcccagttgtctttccatcatctcgtctcctcatatcctctatattctaagcattttaaagcttctcgtgtacaaaaattaatctgatgtgtcggatatttgaatttagctaacacccagaactgttctcttgtaatggctccatcaatataatcggaaacataattataaatctgatcatttgccatcgctcctattacaatatcatattgatgcggttttcctgaacgacaatcaataataaaatctaaccattcatctgtcatgtccttaaattcttttatatttaaatgcgtatttaaccttacctcgtaaatagagacgattttatcatcatatcttttcgcccacctttgagcctgttcctttataactgtacaataaaatcctgtaccaaaatcttttgtgtttcttccctcccgtatttccggatgtttcactggtgtatacccaccatgatataccgtcattttcgccatagaatttcctccatcctcaatattatattttctatttctatctagtataacacatatcctgagttgccgcaggcaaagagacgccgctgaaaagagtggtagtcggattgcctgaagaattatagagaagaatcactaaaaaatttattgattttgttccgttgtgctaaacgctccattttgcccaataaaacagaaacttcggaaaaagcagtccgaagtttctatggtcaaaattccgcagcacaaagtcacaaaattcaataaattttttagtggttctttttcatgttttttgagcaatccgatagaatatctacaacggttgtctatttataatccggcaaatcaattaaaagatttggggaagaagacagaaaatataaaaataccaggcaattaaattttagtggactgatacgaaaatggatgtgaaaagcactgaattttagccatattttattgagattagcatgacaaatgctgtagtggaacaagattgatttgcatatgtattagagcgtgtttgaaacttagtttattattgtaacacaatgataacagtttaaacgtcagtcctttagaattttaactcctcggaatgccataaccatctgacgcctccctcaaatctctccaaaaataaattctgaatttgcttaggcagccaaagacagctcccaaagagagaccataccctatatttgtggcctcggagcaaaggttggatgtaagcggttaagcgaacattcaacctgcagcgactaaagtcacaaatatagggtatggtctctctttgggagcgtctctttgcctgcggcaaatcagaagttacagttttagtacatggaaaagtactgccgttaacacaacgattgcatttgtaactgtctgaaccggtaccgctttcttacagtagtgctgtacatccgtttctgtcaatgcacatccagtataagtagaagagttcgttggtgtagaacttgttgcaagtgacaggttacatacaaacggtgcgataattgcaacagccggtattccaaatcctgcgccgatggaaataaataccggatacagggcattgaaaatctggaatggtacaacgtagataatgacaacgcacagaagaagcataataacgtgaaggtatcttaacaggaaagatggacaaacctgcataagtccgtttgagagggcttctaccatgcctgtgttattaaatactgcctgatatacattaatcgccaggagcatgatcaggatgtttaagtacattgctccaactttgttgaatatttctccgaagttgtctttgtagttaagcattgcagtgattactgttgcaaaaataaatacgaagtatggtgcaataccgaagattccgagtgctacgaggcagagaataaaaaggataaaatttacccagaagagttttggtctgcggttttgattctcctcctgttgtgctgcagcttctacggttgtagtaactgcctggaatgttccgacacgtcttttgtgtttgattccaaagtatacccactggaaaatgattgctggaatgaaacataatccccaaggcatagatgcagctgcgagtttattggcatctaaaccggcagaggaagcagtgtatgccattccaattccccaggggataaagcacattgcggacatggctgtctgtgcaatgatgaaagctgcttctctatcaaaatcaaactttttatacagaggcaccatcagtggaaatgtaataaggtatgcaggtgtaaagttacctgtcaggatgctgaaaccgccgatgagggttgtcaaaaccataataacgattacattcatcttgtttccgagttttgttgtgatagcggaaacgatcgtgtcgaatacaccggcttctgtaagcatctggaaatacaaaaatgcaaacaagagcataaatccagccgatttcatcatggaagcaagctgttctacgatgaaagtacttgtttcttctatggaatgcccaagaatcagtgcacaaagaaccggtgcaatgaaaaggacaaagttaaatggaagtttttttgttataacagtggcaactacaatgagaatcagaataaatgccatgattaaagtagcgttcataaataaatcctttcgtttattatagttatttacttaaatatgctttttaataaattcatctacaatgttaagattttccgttgtccagaaagcgttatcgccatgaactgcattttccattatatagaatgtaacgtctttttcttcttctcgaagttttttgtaaaggcgtacgctctgtctccaagatacagtgtcatcccctgttccatgcatcataaggattggaggaattggtgtggctttttctacataattagcgcaggtgaccgggacagaaagttctggatgttcataaacattattgccgccgatcaactttccttccggactgtctggctcgccctggtttaaagtggtagggaagtcttctttctgacgaacatctgtcacaccgtaaaaatcaacgatggcctttacttggcaagaatattcattgtagtcttccgtatctaaaatgtcctgtccggcagtgattccggcaagtacagcagtatgtccgccgctggaatctcccatgatgaaaatgttatctacatcgatatgatattcttctgcgtgttttcttaaaaatcttatgccggtttttgcatcctgaacctgtgcaggaaaagtagccagatcactttctctatactgtaaaatagcagttacgaaacctcttcttgcaaaatcagccatggcagaaagacgtttatactgatcctgcttcagccatgcggaaccctgcacataaagaatcgccggatatttctgctgtgcagattctggttttacttctggtacgagcatttgtaatgtgcgctccccctctgatcgtgtaacataaacaacgtcatgtttataaacatggtagatttcctgaccagttgcctttatatgatgaacttctttcatctgtggaactgcctggaaaaaagtttcaaaatctgtgttttttatttcttctggtgtcatttgtatctcctttctaacccttgcttatgccggagtatatacagtaaaatatatattcaaatcgcagctgatataaactcaaacagcttatattgttaattatataaccatgtcttgctcgcaggtcaatctgtcaaaatgtataaaaatcataataaattttgtataaaataacgagatttttttatgattaacagtaaaagtgtttgagctgtttctttagatttgggtattttttcaagtgaatataaaaacagtttctgagtgtaccaatggtttagaaatagtttggaaataatttagaagatggcaaaaaacctgtgagtagctcacaggttttggactttaaattgaagttataaaggttgaaaagggaaattgaagcttacttcttgctccaatataatatagtcaagtcaaatcatccccctattcccagtcattctcgagtaagcagaatacatcagcttctgtccccaaatcccctccccctgtttaattcatcttctccagccacagcacagaagccattgccccctttgtggtctcggagcaagtgttggatgtgagcgcgtggagcgaacattcaacgcgccgcgactaaaatcacaaatatgccttattggggggcaatggcttcgtctgtagtgtatctaatgaattaaatagtaaaaaacctattataatggaagctgcatgcgaaaatagtcttttctttccccggtttcatcaagagtgatccgcaggcggaaaccatacacaggagctttaggaataccagatttatattcattataataacgaaggaactcgttaatcaagtctccctcggaagcgtaatgccctctaagactcatgtaagcagtaaacattctgcctccggaaatcttttcaaatccttttttatttttcatgaaatcattatccgtatctatagagattccatgtccccatgaaaatgcagaaagatctcctttgaagtattcaggagaaagttccagtaaagagctgcttttgggagcatattctgcgagattgattccatcggattcacaggaagcctcatccatgtagttcagtccttttgtctgacggcgaaaataaaagtcagggcaatcctcaatgtaccatttaccaaatctgcggtctaaatcggccagttcttttcgataattttctataagttcacgagtatttagtaattccgttacctctgtggtgagttcctgacttcttttttcaagaagggaagaaagcaaagcattatccccttttttaagaaggagctggatgtcttttaaggaaaatcccatatttcgatatttcatacattcataaatatccgtacagctttttacatcgtaggaacgataattggattgttctcttctgcttgaggaaatcaaccccagtttttcgtaatatttaatagtatggacggatacgccggtaaatttagaaagcattccgacagttttttcattcattatttcacctgcctgtatatctggtattactgtaattgtataatgcccctttgataccagattgctacgtgccctgcactctcgcaatcttcaaaaacattcataatccgctcatttttctttgaaaaatggctacttactcatatttttggcgggtcaagaggtcaaaaaacctctcccaagcaagcttgcatcggctttctgactttttgaccctggtatcattacattataatagataccaatgaaaagtaaaagcaggaatatatagaatcggctgtgaaatccatagaagttatcatatattaaaaaacggacaacgccggaatgatatgcgttgtccgtttctttaatcatgaagcattattttgagtctttacaaaatgaaatacagacaagtacacttttgtaatcatacaaaatacttatacttctgtaattaagtatcctttttcttcaagtgttttttcaatcagatcgagtgttttttcggaatctgcttctactgtatggtaatggtagttagatgtgatgtttttaagagggcttgacttgccgttcttaatatcatcgataaatgcctttacttttaatcgggaagaaatgccaagtggggcttccatatgaccgtatacccggtgattgaccattacgtttacaacagtgccgcccaaatccacaatcgagtaaagttcatcttctgtctgagcatctgtgtgactaactttaaatactcttgtaattgtatgcggagcattcaaaatgtatccacgattagtagagataatgtcataacctgcggtacgaagcagagcgatatcctgcacgattacctgacggctgacatcataaagctgtgccagagtcttaccggaaattggtgaagtgctactttttattgtattaattaattcttctcttcgtttcgaaccagtcattgtgtatcattttccctttcattaattacagagcgtgaagattcttcagtgaaatatcaagaacaggtgcggaatgagttagcgcaccacttgatatataatctactccaagagaagtcagatggtcaatattttcttttgttacattaccagaacattctgtttgagcacgtccgtcaataatacgaatcgcttctttcatttcctcaacagacatgttgtcaagcatgataatatctgcaccagcttctactgcttcttttaccatgtcaagattttcaacttctacttcaatcttacgtacaaatggagcatattcctttgccatctgtacagcctttgctacgctgcctgctgcaccgatatggttatcctttaaaaggactccatcggaaagattatagcggtgattgaatccgccgccggcacgaactgcatatttttcaaaaatacgcatgttaggtgttgtctttcttgtatctaaaagctttgtctttgttccttttaaaagagcagaaaccgtatgtgtgtaagtggcgattccactcatacgctgaagatagtttagtgcaacacgttcaccggacaaaagcacacgaatatctccggtaactgttcccatgagctgtcccttttttacggcatccccatctttacagagaaattctgtctttgtgttctcatctaataattcaaatactcttttaaatacatccagcccggcaacaataccatcctgcttacagataagctgtacttcaccttctacagcttctttcataacagagttggttgtaacatcctcactggaaatgtcttcctgcagagcgagacgaatcagttcgtctgcctgaagtttcatggaaattgtattcataggtagtttcctttctatataaataatacataaatttatacggctgcagattcactgaagtctacaggtttaacagtctgttctaaaccacatatcttacgtgcggctctttttgcaaagacaagactttcaagaagagagttacttgccaaacgattcgctccatgtacaccattacaacttgtctcaccaacagcataaagatgatccatagaagtcttgctgtcactgtctacccagataccacccataaaataatgctgtgcagggacaactggtatccattcttttaatacatcatatccctcttccagacatctctgataaatattagggaaatgattgagaatcgtctctttatcaatatgttccatagaaagccagacatgactggttccgtctttttccatctgtgccttgatcgctttcgtaacaacatcacgtggaagaagctcatttacaaaacgttctccgttcttattatagagaaccgcaccttctccacgtactgattcagaaattaaaaatcttcttcccggttctttagaataaagagtggtaggatgaatctgaacatagtcaagatgctctaaacgaattccatgcttcttagaaatatctaacgcatctcctgtcagatgagggaagtttgtagagtgcttataacatccaccgataccaccgcttgcaaaaatcgtatcctcggcacggatgtgcatgatcccgccatcctttgttttagcgataatacctgcacaatgtccgtcctgtacaataatatctgtcatggtcgtatattcataaatcgttacattcggaagctttttcacctgtgcaagaagtttgctcgtaatctcctgtcctgtgatatcctcgtgaaaaagaattcttggtctggaatgtgccccttctcttgtataaagaagtttatcaccgtcatgagcaaaatcaacaccatagccgatcaggtcatgaataatctcctgagaactgcgaatcataatgtcaactgattctttacggttctcgtaatgccctgccttcatcgtgtcttcaaaatagttgtcataatcattctcatctgtcaaaacacagataccaccctgtgcaagaaaagaatcactgctctctaaatctgatttggtaatcataataatatttttatcttttggaagatttaacgcagaaaatgtaccggctacacctgtaccgactattactacatctgtcctaaaatccattgctgtttacctcctgcttactactttgcagccagctcaagcatcttttcgagaggctttttagaattctctcttaaagcatcactgacatgcacttcattctctcctgtcttcaatacgtggagaatcttctccaaagtatttttcttcatattcgggcagactggaagcctgtctggataataaaatgtcttatctggattctgtgtctttaacttataaccaacaccttcttctgtacatacgataaattcctgacagtcactctctgtaacataattaataataccagaagtacttccaacataatctgccattaaaagaatagactcctgacattctccatgggcaacaatctgtgcatctggatgctgtgcctttacattcgcaacatcttccgcctcaatacgctcatgtgtcgggcaaaatccattattataaacaaaattcttctccggcacctgactggcaacataatgagccagattacggtcagggataaagaaaatattcttctgcggcagctcctttacaatcttaactgcatttgcggaagtaacacaaacatcagaatactccttgagcgctgcagtagaattgatgtaacatactactgcaagatcatcgtattccgaacgaaccttcttgatcgtctcgatttctgccatatgcgccatcggacagtccgcattcatatccggcattaaaacggtcttcttcggatttaaaatctttgcactctcgcccataaaagaaacaccacaaaaaacgattgtctgctcttttaactttgtagcaaccttgctcaaataaaatgaatctcctatgtaatcagcgatctcctgcacctcaggacgcacataataatgtgcaagaatcactgcatctttttcttcttttaacttctttatttcttctacaattgtcatgaaataccctcctgtaaggtatggcctttaaagaccccttctgatttttgccaaatttctgtccattataacaccaaagtttacatctgacaagacacctgttaaaaaagtgtaaagaagattacaacaatggcagggattctatatcatatagaaattccctgccattgttgctacataccatatttatttttccaacatgagtgttattttacagtaatcgtaaatgttactttttctttatttgctgtatttgtacatgtaaccgttgtctttccaggttttatcccaacaaattccatttcatcatcatatattccatcatccatatcttcgaatgcaagaacagaagaatcttctactgtccattttaactgacggtcttttactccttttccttttgttttcttaacttcaagttctaattcaccatttactcttatactacgtttcagagagccttttgcacaaatcgttttattttggtaagatgcttttattgtttttttaacatttttcactgtaatcttaaaattaatttttttatcggtttttgtatttcgacaagtaatttttgttgtgcctgctttcagtgccttaaatttaatatcatcatcatgtctttctttcccggcaaatgttacaatagaagaatctttaatactccaagtcaggtttttatctttaacagactctggcttatctacttctagttcaaatatctttcctttaataatactacgtttcttttttccctctctcgaaatgtcttttttctttgtagctgcctgcacagtattaacatttccaattgcaggggtggtataacctgccgcaaacaaaatagtaaataataatacaactgccatcccagggaataaataccttctttttctcatagttttctcctttcattttgcataatttttgcaatcttttaagattttattgaataacttcctttattttatatcttgattatactcacaaaaaatgagaaaatcattaaaaagcatatttaaaaatgacagatgatcaagttaagaaaggagtataaatctatgaggatgctgattgttgaagatgaaaaagatttgtgtaatattttaaaaaaacggttgcaaaaagactatactattgatatttgtatggatggcgaaattgctaaagattatctgaatacctatacttatgatattattttacttgatattatgctccctaaaatagatggaatcactcttttaaaatggctgcgaaaccaaaagaagactacacctgttcttttgctgactgcaaaaagttctattgaagaacgagtaaacggattagattccggtgcagacgattatttaatcaaaccgtttgcttttgaagaactacaggccaggcttcgggttttgcttcgaagaaatatagcagcagacccaagcgacattcttatttatgaagaccttgtaatggatacgaaaaagaaaaaagtcagccgtaatggtaaggaaatttcccttactacaaaagaatataaattactgcaatatatgatgcgtaatcctggacatgttctttcacgtgatcagcttgaacagcgaggctgggacagtacttttgagggaggttctaatattatcgatgtctatatccgttatctccgaaaaaaaattgactccgattatgaaaaaaaattaatccacactgtatatggtaaaggatattgtttaggagagtaaatatgaaaagttcaaaactatcaataaaatttcgaatcaccttttggtatactcttgtgttttctctcattctggctctcgtatttttttatatttattttctttctaaaagctacagtgtccatgatcttcaggaagagctaaaagatgaatccgctgatatactggaaaatttatatgataagtccagcaggaatgatattttgtataatgcagactggacaaaattctatgacgataatgtttctatcagtttatatgacaaaaacagttcttttataaatggtgttttgccagaacattttcctgataaagttccatttatcaacaataaggtacgacagataaaatctgataaaaatatctggttagtctatgactattgttatgaagaatctccggaagattccatatgggttcgaagcatcgcttcttatggacattggtcaagaattctttataatatgctatggatttttgctgttcttttccctattactgttttcatctccgcctttgtcggctaccatatattaaaaaaagcgttacaaccaatttacacgatcagtgatatggcaaaagagatatctttttccgtcaatctttcaaaacgtattgaaacatcaaacactcatgacgaattttcttacttggctgatgcatttaattctatgattgctaaactggaaaagtcttttgaaaaagagaaacaattcacatccgatgcagctcatgaactaagaacaccaatttcagtaatacaaagccactgtgaatattgccttgatgaactaaagctcaccgatagtgttcgggaagaaattgagattatttataaaaaaacaacctatattggccagctgatttctcagcttcttactatatcccgcacagataagcatagttttaagcctcaaaaagaagaagtagaccttactcttttaatagaatctgtcatagaagaacttcagcaaaaggcagcttataaaaatatttctcttttatttgaatatatccccaaaatgaatcatatattattcagggagacacgatgctcctaatgcgtatgatttataatcttatagaaaatgcgatcaattatggtataaacggcggatgtgtctgggttaatcttataaagaaccaggaaaacactgatatcatcatcaaagataatggaatcggtatcgaaaaagaacatcttgacaaaatatggaatcgtttttatcgagttgataaaagcaggagtaccggggaaggctttggacttggactttctatggttcgttttattgtagatattcatggcggaagtattgccgtaaaaagtaaacctggatacggaactacatttactgtgtcattataaagcaatatcattgaccaccccctgatttttgccaaatttctgcccattataacaccaacatttacatctaacaagacacctgtaaaaaaagtgtaaagaagtttctgatagtgtttgaccaccgcctcttttctatgttacaattaagatgaacatatatattgatatgcgattaagaggagggccggatatgatttatttgacaattctcaatacaatatctattctatttttaagaatcgggcgaaggctcttgtccggttttcgtggtgtgataaagctgattttttaagcgtctttttgtcatgtacaaaaagacgctttttttgacccggaaactctatgagcaaatacatttattaagaatggaggtcactttatgaataaatattttaaaaaatccacaaagaggtctgttatttccatgctcagcattgccattactctttgcctactgttttcccttctttttccgggaaaagctgttaatgcagctccaagaatgagactgaataaaactgctgttacactgattcaaggaaaaactgtaaaactacgagtaattggaactaaaaggaaagtaacatggaaaagcagtaataaaaagattgcaaaagtgaataaaaagggagttgtaaaagctttaagccctggcaaatgcaccattactgcaaaggtaagaggcaaaaagctaaaatgtaaagtaacggtagataccgttgaacgaatcaacgcgaaaaaattatatgatcttatacggaaaaaaggtaaaaaaggtaaaggagaagaaaaaaatctaagaacaatttctacaaagttccgtcctaaaggcacagatgattctattgaagtccgtattactgcctacccggaaaaaggaaagctcctttttagctatgattacgttctagattctccatgggatagttatcatacagaattaaccatgaatctcctgaaaaagaaaaaaggtacgatttccagttcttacagaaacctgtatgtcgatcctgtatatactcattctgtaaatggtacgatttctaccttatatgacggaaagtcacaggggcttttcctgacagaatgttataatggggctgattcagatgaggcttatgatgatgtagaaacttctgttccttataaaggcaaaccgaggccagacgatatcatcaaaggaatctaccgaataaatgatgcttttgccaattataatattttacttaaaaaatatggatacagcatgaaaaagattggttttaccaaatggaaaaatacaaataactaatacggtaccgaagtctctttccggtattctgtcatatgtcatcataatacagtaaatgaataattaattcttcataaatgcaaaaatgagagcagccacgatcgctgctctctttggagaaggtattcttgttacactaaatgcaacaaaacttataatgtattgggggggttacgagtattataatagcatttcctaccacgaaagtgtgcataaacatgaagaaatttcaaaatattttttatgcatttttcgcaatgaaatacccctatttgccaatattaaactcaatcttttgttcatatataacaacttcctacagtattcaacgaaaaacaccaattttgtacttgtaaaaatactttttatgaagaaaagaaacagcaaccagaaatgctgtaaattttattttgaaagaatctatgaaataatttgagaaaaacacaaaaaaagatgaccagcgaacggtcatctttttggagaaggtattttttgttacttattgggtgtagcaaaactatataatgtattgggggggttacgagtattataatagcattgggtcacccgaaagtgtgcataaagttttaatgaattgaaaaaaatttttgtgcagattcgttcgaattctgacgacttttgtcattctgactgaaagactataaattctcctcggctgctttatcatttttaaacaatgcttcaaattcttctcggctaatacgctctttttcaagaagtaagttcgcacaggaatgaagtacatccatattttctgtgaggattctcttcgcgtctgtgtagcaatcgtcaacaagtttctttacttctttgtcaatgatgcttgcgacttcctcgctgaagcttctggagtgaccgaggtcacgtccgaggaatacttcgtctgtgttctcttcgtagttgataaatccgagtctgtcggacataccgaacttcgtaatcatacttcttgcggtatctgttacctgtttgatgtcctgagacgctcctgtggttacatcgtcaaagattaattcttcggcgatacgtccgcccatgccgactttgatttcctgaatcatgcggccttttgtctcaaatacgttatcattctctggtacaggcattgtgtatcctgctgccccataccagtaggaatgatggatacggtgtatacagggcctacatctggcagtaaatggaataagattgcatggcctgcttcatggtaggctgtaatcttacgctctaattctggcacaagacggctctttttctcagttccgattccaaccttaatgaaagactttctgatatcctccatgcggatgaatcgtgcattatttcttgctgcatggattgccgcttcattcataaggttctcaagatctgctccagagaatcctggtgttgtgcgggcaatctggtgtaaatctacgtcttctgcaagtggtttgccttttacatggactttaaggatttcttctcttccctttacgtctggtctgccaactgctactttacggtcaaaacggcctggtcttaaaatagcagggtcaagaatatctactcggtttgttgctgccatcacgatgattccttcattcactccgaaaccgtccatttctacgaggagctggttcaatgtctgttctctttcatcatggccgccgccaagtccggtacctcttcgtcttgccaccgcatcaatctcatcaatgaaaacgatacatggtgcatttctctttgcatcttcaaataaatctcttacacgggaagctccgacaccgacaaacatttccacaaagtcggaaccggaaatactgaagaatggcacgcctgcttcgccggaaacggccttggcaagaagagtcttacctgttcctggaggacctactaaaataacacctttcggaattctcgcacctacttcaatgtatttctgcggactctttaaaaagtctacgatttcttttaattcttctttttcttcctgtaatcctgcaacctggtcaaaacggatattctgagattccgggtcctgcatttttgcgcggctctttccgaaattcatcatcttatttccgccgccgccaccgccggaagcacggcttatcataccaaacatgaacatcatgatcacaccaatgacgatccacggcaaaatcatggaaagccagcctgcatcggatgacttcacatcgtctacctgacaggatactttatactgctgtgccagatcaatgaccttattcacgtcagttacatgtgctactttcttctctccatcattcagttttacaatggcagaacctgtaggaacctgtgcgttctgcactacctctattgactttactttattctttgcaatatcggactccagtctttcgtaagaatacgaactgctgccgctccccgacatcagattcttctcagcaaaataattgccaaacatatataccgccaggaacactaccagtaaaatggcagtatttctcatatttctattcaacattgtctcctttctcttccccggaagcctgctctgctccctcctcagcatcttctgctgcctctggttctacaactccgataaatggaagatttctatatttttgtgcatagtcaagtccgtatccaataacgaactcatctggaatatcaaatccaagataatcaatctgaacttctacctctcggcggtctggtttatttaaaagggcacacagacggatactctttggatttctctgttttaatacagggataaggtagtgaagtgttcttccggagtcgatgatatcctccacgataattacttccttgttctccattgtatcatctaaatccttcttaatacgaacgattcccgaactctctgtcgcatctccatagctggatacctgcataaagtccagagaaaccggaactgtaattctctttgctaattcgcaggcaaaaaatacaccgccctttaaaatacaaatgaggtgaacttcttttcctgcataatctttgctgatctgttcaccgatttctttaatctttgcgtctacagtttcttctggaatcaaaacattaatcttatctgccatttccgtgtcctccattaaaaaattctctaattctcttctttctcctgcaccgatactctaagcacccgctttgtctcgctgcttaccttgtaaaactcgctgatgcgtcctccgattatccacataatatgggaaccatctgccagcagaagctgcccgtctctgtccgaagcaggaattttcgtatcaataaaatagcgtcccagtgatttacgccgtccttctttatccataataaaataatcgccggtatctctggttcttaaacagggtttacatttcattttatcataatcaaagtatttcacacaatccctttttgcaactttcccgccattccacggtaaaatggaaaaatggattgtaaatttttgcaataatgtctcatttgacaatactatcgtttcttctgcctttgattcttctgattcggcagtcagctgcaaatatactggctgcattttatcttctgaatgattaccacattttttattttttttatttaaattctctaaattctgttcatcactcttttgttgcccatctttttgtttatttttatctgaaaatgttacatcagtcgacaacttcattaataaaagtccatcccgcactcgctttgcaagcaccccatacggacaattctgctgcttaccttccttatttgccatcagtgcaagcatctgttccacatgaacgagggaaatgtcttttcggtgtcccgatatttcaaaaagcatccgtctcatcatttccttttgttcaaaaagactcatcacagaaaatgttttctcttccaaaaacagctctccctgttcatttgctattacattttcattatataatttttccatttgcggggtaacatatgctaaaagctcctgcatctgcattccaagctcgctgatatgtgccgctgccttttgattgacatgttccatctccggcaaaatgcggtgacggatataattgcggctgtattcttcattcgtattcgtgctgtcatcgacataattctgcccgatattttgaagaatatccatgatttcttccctgcttaaacagagaaatggacggataatctttccattgaccggcaaaatgcccgccattccctgcggtccagtccctcgcagcatccgaaataaaatcgtttccgccgcatcattttgatgatgcgccaccgcaatctttccacaatgatactctttcgcatatttttcgaaacactcatagcgggcgattctgcccgcctcttcctcagaacattttttctgccggctctcctcttttatattacggtactccacatttagcgagaggttccacttgtggcagaaatcctgcacgaactcttcatcccgctttgcctcctcaccacgaagcatgtgattaatatgtactgcgtacaattttaaagaaagagcctccctccttgcaagaaaatatctcgcaagacaaacagaatccgctcctccggaaatcccaagtaaaatggagtctccctcctgtaccattttccattttttcaagaaagaatctactctctcccaatgtttatcccacatttttgtgttcctttctcccagatagcagctaccagcaccgttcggtcatcgtcataaccgtcctctaacaccggaactgcttctattaattcatttgcaaaaacctgtgcattatttgtctttatctttccaatcaggctttccatacgaaatgaaatctctggcatattttcaaattccagcattccatctgataccatgattaccatatctccatcatatagctttttatatttcaagtcaaactgctgtccaattcggcatcctggaggaagcgcagctggcataatcctctctactgaatttttatgccggataaatgtagccattcccctgcctttaacaattttaatatccctgtttttaatgaaataaccgccgcatctatcgtagaaaatgctcccttatcctgaaataaaagagcatcctgtatcatttccagtgcaaactcttctgagattcctgcttcaagcaaatcttccaatgtctcaatcaatcgccggctatcctcattcgctttttttccagtacccattccatctgacaaaagcatgaccgctctttttcttccaaaattagtaaatgaaaatgtatctccacaaacatcttctccttttttattacaacatctttgtccaaaaacgacatgaaaaccattctcctctataaaagaaatcctgttctctcccggcctaagccatgttgtttccatgttcctgtaaaaattcctcttgtaatatgtattcaggcattttcttaccagttctgctttctttgtccccaaaagaggctgcacctgtaccgtcacctgaagcaatccacttccatctttatattcttttccctttataaaatgaattccttttctgaaaaaaagcgtttttaatgccatcttttttcgtccacagatttcttcacctttttgcatatttacccggcactcccgaagaaaaaggcgctgttcatctaactgccggcacataacctgttttatctcatcatacctttgttcccagtatatgttttgataaatgagacgatataaccatgatatttcttccataaatggctgaaaaaaaacacaattcctgcgaaattctgaggatgccatccgcccgtctactccagaacactggtaagcctgctccaatatcgaagcaatttctccaatcgtttctttttgtctgcttccataacattctctatatttaggacatttgcggcatacatcctgcatgattgactgacacaaaaaatccatgtcattacccagcacatcttttttctctattttcatcagttcaatcaatctggaaagtccctcttcaaaaagaagcaggcgctgtatggcatcctgctcgttataacttctgttatgcataataccttccctccacaatacgatttcagaatcattatagttgattcttcgaaacagatatgtcgattggtggcaacgccgacgaaaagctgaggcttctggtttgtcgctggcaaaggagacgctctcagggaatataatagtccatatttgtgactttcgtcgcggcgtgttgaatactcgctctgtcgctcgtatccaacacttgctcccaggccacaaatatggactattatattccctgagagctgtctttggctggagagggaaaattcagaatttatttcttgagaaatttgcggacatctttgcttaccaatgtcaccaatcaccttgttcaagatattttacatttacaactttcttccctgaatcttccaatggatttgttgaactgtcagcaaacaactggaagtaaacaaaaaccgctgcccaaatcctcaaatcctctcaaaggattgaataacctttttatttcttacgaaaaacagaacacaaaagaagcttataatagcaatggcaacttagagcgtgtttgaaacacactctaggagctgctcaaagatactattaatgaaagttcctccgtaaaataattgattttgcgactttgtgttttttacaactgagtcaaaatcaattattttacggaggaactttcacccgatacccttctagcagcgactacattcacctctactattataaacttcctttgtgttcgtctctttccagaaaacaaaaaaaggcttatacaagcctttttcaaagtagcgggaactggatttgaaccagcgacaccgcgggtatgaaccgcgtgctctagccaactgagctatcccgccgcactcaacaggcaatatcataccatgtattttatgatatgtcaagggtttttcaaaatttttaatctgttttttgtattgttgctttattctctgtctgagattgtgttgtctgatctgcgctttccgttgtctgaccgctttgatcttcgcttgccattgtggtttctgcgctgtctgccgccgttgtactcgctgattctccttcctgggcttcctgcaaagaaatttctccctctttgatcattccgagacgctctctcgcaattcgctctttagactcgtccgtatcaatattattcttttctttttcaagtgttttattcgtctgatttaaattcttcacttctgtctttaattcatcaattgtcttctgatacttcgcagcttttctctcaactttctggtatgctccccagaaagcacttaaaataataactgtacaaacaataataatcgcagactttttcgtaaaaaacgtcttcttgaactgtctgttaaactgtttactgtttttcttctttttctttctcttcttcattctgcacctgccaaatcctgcctcatttatttcttcttattattttaacggttctcctcatatttttcaacattttgcctgtatttttcacaattacttttcctggaaaaagtatgattccccctgtaattttcactattttgctaataattttaataaatacagaaaacagctttccaatcacttcactcaaaaccaaaaaataaaaaacagccccacattctaatccaaccagacaataaaatcgtaccattccctgattatacacctgaaacagtataaataatcctatagctgctgtaaaacaaaaaatcacatcttccaaatgcaccattttgtttttatgtacaaaattttttcgaagcgttcggaaaaattcataccataatccgagcaaaattccatatagaccgctaatgaaaaaaagatgaatctgctttataataatatccgctatttttttattttccatttagtggaacaacctcctgagcagacctcctttttcccctttcatatatccgtcatccgaatacaccatgctgtataccagtccttctatctccacctcccctttttctactgtaagttttgttacatgcagttcttctccctgaatcataagcattccctgttccgtatctaaaataatctcatttgggtcaaaggaaattacctcttttacaccgcttataatcccgctgcttcgattaaaaagtgaaatcttatgactctttaaaatcctctcttccataagttttaccctcatttttattcctttcattatatgtattgctaataaaatatataaccctgtaaaaattgcaggaaacaccttgacaaacacttccaaaaccgttataactattgaagtaaatgcgcttttgcgcgatatttcaatgagacaatgacaagaatatcaggaggaatttatcatgaataaaacagaattagtagcagcaattgcagaaagaacagaattaacaaaaaaagatgctgaccaggctttaaaagctttcattgatgttgttggtgatgaactcagcaaaggcgagaagattcagttagctggattcggtactttcgaagtaactgaaagagcagctcgtgacggaatcaacccaagaacaaaagagactatccacatcccagcttctaaagctcctaagttcaaagctatgaagtctttaaaagagaaagtaaataactaattttattaattagatcgtgtttaaaagtcagcgtccgggaggacattatgagactagataaatttttaaaagtttcccgcttaatcaaacgccgtaccgtagcgaatgaagcctgcgatgccggtcgtgttcttgtgaacggtaagaccgctaaagcaagtcttaatgtgaagaatggcgatgttcttgaaatccagtttggaaataagactgtcaaggcggagatacttgatgtgaaggatactgcaaagaaggatgaagctaaggagcttttccggtatttgtagggagataggcggaacagacaaaacagacgaacccagaaagataaataaagcatatttgtgactttagtcgctgcaggctgaatgttcgcgtaaaagcgctcgcatccagcctttgctccgaggccacaaatatgctttatttatctttctgggttctgcttgctggcaggtcggaaaatccattggagggatttagagtgtgtttgaaaaatcattccagcaacctgcacgcctcaatttacggtatcttctctctttgggcgcgtctttttgcctgcggcaaactggaatttattacacactcacctgttttcccaaaaattccgccgccacaagggcgatcttcttctccgattcccccagtcgttgttttctatcttttgcctgtataataatcgctcccattatctgtccattgcttcggattgcctggcagatttgttcatgttcttccatgccatgaattatcggaataaagcgatttctttcggataacggtaatctctcatctctgtcatccaaaatattctctaatatatgactgattggttctccgacaatatcctctcctgtgtatccggcagcagcaacaactttttctctgtctgtgacaaagactgcattccccatttgctgtgctacacactgtgcgaattcttccgaaagagaagacatttctgaaaaaggcaaaaattttcgtaaaatgattcccccttctttatccgtgtaaatctcaagcggcattccctcttttaccttaagagtctttcttatctcctttggtataacaattctgcctaaatcatctatacgacgtacaatacctgtagctttcataatatcttctccttattctggttttatagataatgattttctgctgttagtattgctcatttttttgaaattatgactctgtttaccagttttcggagaaatttcgttttgccgcataaaaaacgcccctttttcttaattcaagaataatataacaaaattgtcgaagtccctaatgaaagaagatatcctttcttcttgggtgtctgtctaatgaattaaatagtaagaaattcttctatttctttccaggcttctcttgattctttcatttttttcattccaagctgaaagacatggaacatttcatcatatatggtaagctgcacttcgcaacctgctgctttcgctttttttgctgctctcgcgctgtcacttaaaagcatttctgcaccgcctacctgaaagagcattggcggaaacccttcgtaattaccgtaaagtggggaaatgtatggtgttttagggtcattttccccataatatgcattgctgtaaatcatgctgtctgtcgtattaccaaaaagaggatctttttcaaagtttgtctcataggaatctcctgtggctgccagatctgtccacggagacattaacacaagtttcttcggaagcggctctcctttatcttttaaataaagacagagcgctaatgccaggccgcctccggcagagtctccgacaacaataatctgacttcccctacatcccatttcaaggagccactggtatgctgcgtaagcatcttctagtgctgccggatatgggtcttctggtgccacacgataatcaacagaaagaactgccctttctcccggcattcttgcatacaatacggcaaaatcccggtatgcatttttcatttttccaatgtaacctccaccatgaagctgtaaaacgacttcacggttctcggtcagcaggcgttctgctgtatcttctttgcccgcccggtcttctggcatattgctatcatcagttttcaaatattccaagctgttattggaaaagaactcattttgatgcaataacaattccattgaaaaatccggcatctcaatcggaacaagtgaaaatcctcttggcggatgccacggcggttctatctctgccactctcttccgaaatgtcccattctgaatcagcggaccaattccatgcagagaagttgcaagcgcaataacattcttagacatagtcgctgccagactgattgacttatcttttctgcgtttctttcttcttgccctattctggcgaaccattcgctccattgcagatttatccacagccttctctcttcttccactacttgtccccaaatttcttctattcatcctcatctccctattcactattttaattttttaacgtttgtttctgtttacacaaaactatagaaggctatatatgaagctttcgcttcaattcattctttgccttgcggtctccaattatcatcgttccgctccacagcaatacggacaatccaaatgcaatccatgcaagtacgatatgatgcaaataccccgtaaaatgtaatactacatctaatatactgagcgcaattgccgcaagctgcataagcagataattttgccagcttgaagaattcacgctcatacaaatgataattgcaagaaccaatccataaataatgcacggcagaccaaattccagtgaccatccactccagtcaagggcaaaatcgatcaaaatcatcagtcctaatataacaaaaatctgtgtataaatcttccggatatgcccctgtcttctactgaaaatatcccacattgtcaatatgagataggcaataattcccccagttacaacagaccagtatttcggtgccatatcaaatgtcagatagttgataaatgcaagcagcatttctaacgcaagcgaaataaacaggagaattcgccctgcttttcggaaacgtcttgtatttttctttacatcaggatagcccggaccttgtatcagaaatcttttatctgctacagaatctatatcaacatacctggctccattatattcaaattcactatctggaaatccgctgcctgatttctgtccctttgacttttcttccgtcaatattgtatgacacagcgggcaaaccatcgtatcatccgcaacccacacgttgcatctcttacatttattcatgggaaaatgcacctcctctcagcaaacactttctattaattatagtacattcaaactttctattcggaatgccagagcgtgtttgaaaaatgcttttcattaatcataatacactccattcgtttctatctctacatcaatgccgtcctccgcaagacttctaaaaaatactttctgtactgaagtatcctttaaaagcgaactaaaagtaaatgtcagttcatccccataggagcagactgttgcctttgtattctgcccggccgatggagacagtattatctgaaaacgcttgatatatgggcggtatgcctcatccaccatcatttgtcccatatttgtaatcgttgttgtcgttgccttcgcactcatcaaatatacaaacttaatcgctggctttttcaggaaaagagggactacccgcaatgcataattcttctgattcgacacattgtatgcaatcattttttccagattctcctgtgtaatctgcctctttaactctgcctgcaccagcttcatcacttcctgccgctcgtatttttccttttccggtaaaaaagaggcactcgccatcgcaaagaaattccttgttgtcattgagccaaaaaacggccgcagattcaccggaacacacagcacaatcggcttttttgaaacatttccatgcaaatatcctttataaatgctgtatacaaaaatcccggataaatattcattaatactcatcccaagttcttttgccttctctttaagctgcttcactgacatatacccatgaataatccctagttcacctcgaacaagacgttctcccttcatgtgcactgctggaacagacttataagtcttcttccctgcctttttataattctttaaataactgtcctctgtatcaagcgacgtatcatcgcaaagccggtcacccatctcacccgaaagctgcggataacaaattctcaaatactgatatgtcaattcccttaaaaagttcaccgctcccattccatctgcaagcgcatgaaatacttccaaattaattcgattcttatagtatgtcacccgaaataaataacttttattccgatgctgctctatataacgacaaggaaaatcttcctcctcacgcacaactggctttccctttacatttgtctcaaaataataccagaacattcccgttctcatccgtacattcattgtgttaaaccagggcagaacctgctctaatgcctcctgcagacactctggctcaatattctccgaaagaattacagcgattctatatacatttgtcatcgtctcattcgcgataaccgggaaaagattcgctgtattatcaagcttctcccaacgcgtttcttttttctggactctgcttttcatctcgtactcctgtctgtatgataatattcacgcagttttattatatatattaccacaaaatgttttaacaaaacagatgaagtagaaagcttggtattcaaggcgaactgacgaaccatcatagcgagttaacaaactgacgaaccatcattctgagataccaaactggcaaactgacgaactccagaagataaataaagcatatttgtggcctcggagcaagtgttggatgtgagcacgaaagcgaacattcaacacgccgcgactaaagtcacaaatatgctttatttaccttctggagttcgtctgtttatctgtcgctcccccttgcctgcggcaaatcaccccctcttatgtgcttttccataaaagagttcggctaatttccctgttgtcatttcttctcgttcttttccggtcagatccatgactatttttccagaatccagcataatcgtcctgctaccgtattctaatgcatattccatatcatgcgtaatcataagggttgtgatcttattttcctcaacaatctttttcgttaatgccatgactttttcggctgcgccggggtcaagggctgcggtatgttcatcgagtaataggagttctggttctgcaatggttgccattaaaagagaggctgcctgtcgctgtccgccggaaagaagaccgatttttgttttcattctgtcttcgagtcccattccaagtgtggaaaggacttctctaaagtaggcactgtcctttttatttaaggcaaagaaagacggggaagcctttcttgtgtaagcaagggcaaggttttcctcaatggtgaggttcggagcggttccacgaagtggattctggtaaaggcatccgatgtttaaggctcgtttgtagtcttttaatttcgtaatgtctttgtctcctaagtacacttttccttcatctggaaaaaggcttccgaggatgacgttaaacatggtagatttaccggaaccgtttgaaccgagtacagtaacaaactgaccgggttctacggtgagatttaaatggtcgagggcaactttttcattgacagtgtttgcctcaaacttttttgtgatatctgtaagttttaactgactgctcattaacgtctgccccctttctttttatatgttttttgtaaccacggaataactaatgcgattacaacgataactgcagacaataatttaactgcatagcttggcatatcaatcttgtatgcaatctgaatgatgattcggtataataaggaaccgagaacaacaccaactgcctgtattgtaacggaatgattactaaagaaagtaagaccgatgattaccgaggcgagtcccataacaagcataccatttccacagttcaaatctgcgtatttctgatactggcaaagaagtgcgccggaaaatgcaacgagtgcgttagaaatcatgaccccgccgattctggatacatctgcattaatcgaagatgaacgaaccatttcctcattatcaccagttgcaataatcgccataccatttcttgtacggaaaaatgtaacaagaactgcacaggttacaataacgattatcatggtaagtaaaaatgcggtcatgcctgatgacatatccttgccaaagtctctctggaatatcttgtatacagtatctgccggtttatttacggttacgcccaagctgttttttgcttcatactgtaaataacggttggactgaccacccagaatagcatagtttactgtgtaaagtcccgtcattgtaaggataccagataaaatcggttcaatctttaatttagtctgcaaaagtcccgtacaaagtcctgctgccgctcctgcaagcgtgccagcaacaagccctaaaatcggatgtcctgcaatcgtcactacgacacaggcggtcattccaaatacaaaacttccctctaccgtaaggtcaggggtttttaaaatactaaatgtcagaaaaacgcccagggccataggggcgtagataaacccctggccgagagcggaaactaacatgcctgctatttcattcatgtttatgtcctcaattctaatcttgattcattatttattaaaatgacttgttccatcttcctctacaagcacatcaaattcttcaaatgccttcttatcgaagttaccaccaaactgttttacagcctgcatatttacatattttgcataatcagaaattgtctcgtaaggaatatcagaaactttttcgccgtttgcaatcttttctaccatgtctgcaacctgttttccaagctgtacatagtttacaccaactgtagcaaatccaccgtctgcaaccatagagtcagcaccacagtagataggaactttcttcgcgtaagcgacatctgtgtaagtagccattgctgaagcgattgtgttgtcattaccagtataaagtgcatctactcctttagaaatcagggattctactgctgtctgaagctcagaaacattagagatagaagactcttcataagcgatattattatcgtcacagtatttcttagctgctgtgattgtagatacggagtttgtttcactggatgtatacaggaaaccaatcttcttgtaatctggctggaagttagcgatcagcttaacgatttcatctgctggaatgttgttagaaacacccgtgatattcgcacaatcttctcctgtaagacctgctgcttccgggtctgaaactgcggcgaatacgattggtgtatcttctccatcataaacgctctttgctgtctgtgctgtggaagttgcgattggaacaacaatgtctactccttcagatttataattctcaatgatagagcttaatgctgctgtatcaccgtttgcgttatctgttacaactttgatgttgtcgtcttttccaagttcagaagtgatagtatcacgaatctggtcaagggatgtgtgggacattggctgaacgactgctacagtaacctgttttcctgacttactacttcctgtgctgctttcggaactgctgttagaaccacatcctgttaaacaaagagttcctgccattgctgctataattgctgtacttacaaattttttaaattttctcattttcttttcctttctatatctgttgcccgaagtttttaatcagcttatattgtaaaaaccttctccccaagattatataaatttaaaaatttaattgtttcagattaaaacttgtgtaagctggtctgctgtgatatttaatttcacataagaaaaagattcaagtgaaaaactatgtaaaaaattgtgttaaatatcagagtgccagcaattctaagttctaattttcacttgccatttttatatgctttttaattacctcacaagatttgttaagcatctcctgttcttcctctgttaatggaagttcgattattttctcaattccatttttaccgatgagacatgggactccgcaatgtacatcatgctgaccgtattcgccttgaagtaatacagaggccggcatgatttttttctcatcacggaggatgcaggctgccatttcagttaatgctctgccgatgccaaattcagttgattttttgccttcgatgatagtcattccaatctgtctggttgcttctaagactttttccttagaaatatcataagcatcgaatggaagtcccccgattgttactgatgagaatggaatcatagaggaatctccgtgttctcctaaggaatatgcctgaatagaacgtcttcccacaccggattcttcgcttaatgtccgaattaatcttgcggtgtctaataaagttcctgttccaaagactctgtttctttctaaaccaagtccttttcttacatagtcggctacaatgtcagctggattggtaatggttacgacaattcctggaatcttgtatggttttaactgttcgagaagttcttttaacatttctacggaacggcctaacatatcaagtcttgtctgtcccggctttcttgcctcaccgattgcgacaacaacgagagctgcatcttcgcaatctttatagtcaccatctcttactaccgtttctctctcacagaagcttacgctatctgcaatgtctaatgcctgtgcgtgtgccttatctttatccacatccacaaggacaatctcaccggctatacccgaatgtgccagtgcatatccacagtgggaaccgacatgtcctgcaccgataatcacaacttttctcattttcatcctccttatccacaattatcaaagtttttccacaatacagctttgttgatgtcagagaactataaaaaaacgtccctgacaaatattctctatctgtcaaggacgggtaaaactccaaaaattctcccgcggtaccaccttgcttcatgaaaatcttcatgcactcacaggatacacatcatatccctgacaactaacgtatgtcctcacgtcaatgctagtaagctttaaacttccatatcaccgtattctatcagtttctgtacttcttcaaatacttctgtgcaagataattgatatctgcctgaatctgctgttcacactgccctccgtggcccacttgacaatctgcgttctgtccggttctcagcatcccggtctctctgtaagtgcatcaatcgccctaacttccacatcatcggtttaagcgtccgctgtatttactttaatgcgttgattatatacccacttgataggaaaagtcaactatctattttccaattctttttttcgcgcgtatatttcttctttgattgtatcaagtgtctcgatttcgtccacttcttttaacagctgcatataaatctttttcttctctgctactggagtatttcccataactttgcgtacaaaatacttctcttttgtcatagttggcttaaatgtacgcgcataattctttgttgtctttttaaatccggcaacttcaaggaatcctttttcaagtaaagcattcaccatgagatgaatagaactgttcttccattccttgtccccagatgctttgataatctctgaagcagtaagtgcttcttcctgctcccacattacctccataatcgccaactcgctctttgttaaatgttgttctgccatgataatctctccttaaactttatatatgtttatttatgttcactacacccttttaataagaatgcattatatcttgcctgcttcatgacttctgacaaagcggccttccactgccatatctgtccaggcatttctttgattgcattctgtccttcctttacaaaatgatttttcttagagtgtattaaaaaatcctctaattctttcgtctttttctgacaatattaaatataataattgccacaaatgctatgataccacatccggtaatcataaatgcaagcttaattcccggaagctgataatgcagcttaatatcatgtgttccttttttaagattaataccgatatactgataatttaccctctgaatatctgtctttttgccgtcaacatatgctgtccagcctttctgatatgggagagtgaccaccagcatcttgtctttgtcaacagtgatattaccagttaccgtattcttctctgcttttgcattctgcagggaattctctttaagtgcattcactctgtctgcataattagacatcgtctgagaataaatcgcaagatccttatacttcaaagtgcctgtaccgacaaacttcaaggtacatgtctttacagcaccctctctgtatcccagattaaaaagatattccttttgcccggtagtatatgcatcaatacggaacttatgaccatattttacgcccggagccttaattcttgctgttataaaatgctctttcgcatctttttctgcataaatatctccaaccagagacagataagtttctgcattggccggcgcctcaaaggagaacttcatcgtcgcacccggcttctctatctctatcgtatcttttgtcatagacacaccgttaagctttatatttttaatctttaacttttgtgcagtaagcggaagcttcgtagccacagtaagattactgttcttatccatatccttatcttccacaatagctgcaagcattgtagtctcctgcttttcggctgcagaatactgatcaattctatctgtatttactattttatcgtaagtatacccaagtggcaaggaatattgattctcataaatagaataatatttattctttgtctcctgcacctttttatagccatatggaattgttgccgtattcttctttgcaacacccatatacttcacgctcgcaagcgtattcaggtaagtccggaagttgtaatcatagatacttacaatattccagcgacaattacccatcgcattattataatttacaataccgccatttaacgtactgctaaatgtagaaacatcattatatccatataacaaactggaagaacgaaggttacccgttgtaacaagattggtacttcgataaaattcatccgtatccgctcccggcacttcatcaagatgctttaacgctgtcccggaaatcttctttttagaatcccccgcagaaacgtaggtatccagatgcgtataactatcatccccagaagtaataaaccactttgcattaaggaaaataactagggcagtcattccaagaacaattcctctaaactgtttcttagaaaatgtaattttatcgctatttaataagaacagcataatcagcgtcgctgccaaaagtccaaacgcaccataaatacttggaacaaacaacttgtcagagaaagcatttactagcccgtaaagtccagtgatcgctgtcatgattcccatttcttttccactcagatctcgcatcttatcaagactttctgccagaataaaggaaacgatcaccacataaatataaccccagcggttatttacattactaaatccgctgaaaatatatccgaaaacagggaacagggaaaatgccgtgaaaatcacaaacagccagcgaagttcctttcggttctttcttgtaaaaagtaatacgattgccagcattgcaagcggagcaaatccaagcttaagccataaaccagacgcaaagttatccgatatataggacgtgaaaaagtccaccagccattctgtacggtaaaataatggtgttgtacttaaaaatgcagtaatctttccaccaccacttcggcttgaacccatgtaacttccaaaagatgtaaataatgagatcactcctagggatgcccccagaatataacttcccactataataaatcctcgctcaaaaaatgtcttccaattccgatattcctctgtacaaacgattcgaagcacaaaatagattcccagtgcaatcgtgttcatatacagaaaataataagaacacagcagagaaacccctactaaaactgtgagcatataccattttctattacgaatcagtctctccatcgcaacaacaagaatcgggagaagaatcattggtgtaaggaattgcccatgcttcgttcccgcataaatcgcatagccggaaaaggcatacacaatacttgccgtataagctgcaaaatgtgactttttaaaataaagtacgagaccggacatactaagtcctgcaagaaaataccttacaataatcaggaaactatatgcattctctatcttcgccggtgagaatagcaggtataaccaataaaccgggtcataactgattgccactgtcgcaccaagtcctgttgtaaaatcgtactgtttaaaatcaaagtttccactgaaaatatctttaaatatctcaggaatatactgaataaaacgatataccttcggaacatactgcccaagaccatctgcctcccagattaacgttttattctgtaaaatgtatggcaggaaaataagcactgccatcaccacaaaaagcacagtatatccaataaaatatctaagtaaggaacgccagttttcctctccctctctggaagccggtgttgttataatgccccacactctttctaaaatattcactaccgcttcttctaatgccgcataaataccggcaaatggcacacatatattaatcgctataaatgcaaggaacattccaagaaatacaaaacatgccgcctttatatgaagtactgcaaacactcctgcaataacaaaagaaagcgccgccataataaaattctttttttctaaaaatgtattctgctttttcctagcacaaaatacaccccagaaaaatacaaataattccgtactaatcgcaactgcatgtgtgcggtctccgccaatcaatgttcctgccagaccatatccgataatcccttctggaagaaaaacaggcagaaaaccaataatacatatcaatagaagcaataccggcttctccatccatccttctatataatcccacaaataggcacacaaaagaaatacaatgctgacagacaaaaagatagctgaaatttcaaaaacctttataaacgatatgaaattccttattgtcgtaaacggatccacatgttttgcgaatacttcataaggaattcccaaaagtgcatacaatccaagactataggccgcatgccttaacatacatcccttaaagtccccatacttctcactctgaatctgtatataatatcctactgcaaaaaagattcctggcacatacacaatctgaactattcgagtaaacgcatgaacaatatgcacctctccaaacttatgacagagtgccgtcattaccaaaaatataaaataaaaagctacgataagctctctggaaaaaacttcgcgccttgaagttccatttttcccttgtatagacatcttataatcctcctgactttatcacataacgctattgtacgtcattgtctacaaatttgcaatatatgggatgatttatgatttatcggtggggggtaaacagacgaagccagccctaagggaataaaataatccatatttgtggcctgggagctacgagggtgtagcttagtggtagaaaagcccggcattaaaataattgattttgacgactttgtgttttttacaactgagtcaaaatcaattattttaatgccgggcttttctcagaagactactccccgctgcgacgaaagtcacaaatatggattattttattccctgagggcgtctatttgcctgcggcaaaccagattaataagacaccactgttgttcctattggcattttatcatagatatatttcgcatcctggttataacagcggacgcatccatgagacgctggttttccgattgtcgggttctgtacagaaccgttattccataatggacgtgtatggaaagagtttcttcccttataatgtgttacatagagttcttttgtgcttgtgtagaaccagcctttttccttataagtaatcttaaatactcctcttggagaatgattctttgctgttccggtcgcacagataaatgtacggatcatcttccatttgcctttgcttccctcgaaaatgcttacctgctgtgtataatggctgatccagattaaatactttgttttactggaatatcccttatagtttacaaatgctgtcttaacttctgttgaatacttctttgttgtgtaaatacatttatttccaacgtaaccgatacttcttacctggctggcaagcagtttattataattcttatctctatactgtcttggggttactgtaattaccttagatgtcttactgcttaagtaaactttgtttccaattctggtaactgcctgtactttgatgttatactttgtatccgctttcagtttagcaagactataattgctcttttttgtctttatcagtatcttatatttggaatctgctgccttcttatataaaatatgatagctagttgcttttgctgttcttgaccatgtaagtgccagattctttttggaatcaaaagttaactgtacattccgtacctgcccggcaactactggaatcttcgctaaaaccgcattagactgtgttccgatcactatctttccaccagcctgtgaaactgctacaactttgaaataatactttttaccaccagtcagtccctttatttttaaagaagtggatgtgcatttgctcttggctactttatagccagatgaagactttgtactcttataaacagtgtaataagaagcattgctcacagcattccatgaaagctttgctgcattcgcatttggtacagcttttacaccttttacctttgcaggcttcttaacataatcaaatgtcttaagcattccctgtccataataaactgtcttattattgttaagagtggtctgaccaattaaataagtataatatctggcattctttaaagatgaggatgcaatagaagcagaggctgctgtcttacctacacttatccttttctgtgctactgttgagttttctcccagatacagttctaaagaatatccagtatatatcttgtcagacactgtccaggaagcttttacagaatcattgcttttctgcttgatagaataactgccaagcgccttacctgtataatagtgaactgtcagtttctttgtattatccttacttgtgagaataagcttatattcggtcttagcagaataaagctggccaagacttactgtaagcacacctttctttgatgcgagctgcgctgtatctgtcttagctcccgtcttctcatttgttacagtatatgtataacccgcatctgaaaaatccgcaaacttaagtactaatcttccagaagcatccacataagcaatcttgctgacacttgtttcctgtggtgttgttgctgcctgtgcagacttccctgccaaagcaaacgaaaaacacaatataaacaatgctacaattcctaaatgtttcttattcattctttacctcccatattattcaatgtgctcacaaaatcaagtacaggaaagattccgagagtacactccatcacaaattatatagtatcataaaaaaacagctttgttataagtatatttctgttatattaaaattatattaaaacagaaatacgacacaaataaggtttctggcattttttataaaatacttttctgttttaaaatgattccatatcataataaataaatttatatttcttgctttttacaaaaaaggcctttttatattatataattaaataaaacccccgtcaagaaatctgcttctttaaaatttcctgatattttcacccctttgtatggaagaaactgtacatttttcctgctctctcactatacaattatcctgatttttgctataatgatgtgaaagtatgcgtatgatagttcgtgtactgttactgttaacccatttatttatactattttataaagaaggaattcatatgattaactttaacattcccccgtttacgggaaaggaaacagaatacatgacaaaagccatccagaatcacaagatcagtggtgatggagaattcactaaaaaatgtaacaaatggattgaggataagacaggaacagcgaaagctcttcttactacctcctgcacacacgctacagagatggctgccctccttgcagatatcaaaccaggtgatgaagttatcatgccatcttatacattcgtttctactgcagatgcatttgttctgcgtggtgctaccgctgtatttgtagatatccgccctgacacaatgaacattgacgaaacattaattgaggatgctattactgataagacaagagcaatcgttcctgtacactatgccggtgtttcctgcgagatggatacgatcatggatatcgcaaagcgtcataatcttctcgttatcgaggatgccgcacagggcgttatgtcctcctataaaggaaaggctctcggaacaatcggtgattacggctgtttcagcttccacgaaacaaagaactacagcatgggtgagggcggctgccttttaatccgtgacgaaaagaatatcgaagatgccgagattatccgtgaaaaaggtacaaaccgaagcaagttcttccgcggacagattgacaaatacacatgggtagaggctggttcctcttatcttccaagtgatatgaacgctgcttacctttatgcccagttagaagttgccgataagatttatgatgaccgtatgagcacatggaacacttactacgagaatctcactcctttaaaagaagctggatacatcgaacttcctgttgttcctgaaggctgcgtacataatgcccatatgttctacatcaaagcaaaagacttagaagaacgtagtgccttgatcaagttcttaaaagagaacgggatttcttctgtattccactacattcctcttcacggagcaccagccggacagaagtttggccgcttccacggagaagataagtacacaacaaaagagagtgaacgtctccttcgtcttcctctttattatggtttagaaaaagaaaaagttctgactgtctgcgaaaagattaaagaattttattcaaaatagcatacattcaatattatatgctactgtagtatccattcggtaataatagtttattaatagtcatttagcagtttctacaataaaagttgcacgaatcaaactaaaaactatatccaaataatacttaaaaaccagatcaatggaatactacgaatattcaaacatattaataaaccgttgaatatttagcagatttattggaaacgaaactactcaggaggcaaaactcgtgttacactcgattattataccttgttataaatcttcacggactattcgtgaagtcgtagagcttaccagtgcagagctcgaccgcttagggcgcccggaatatgaatttattcttgtcgatgactactcaccagatgacggagcgacccttcgtgaattaaaagcactggcagctgactatccatttgtaaaagcaatttcccttgcgaagaactccgggcagcataatgctgtcatggcaggacttaactacgcacagggcgatcttttaatcgcaatggatgatgatatgcagacccacccttcccagttacattttctgttagatgaaattgaaaagggatatgacattgtttacggctattatccagataagaaacattccgctttccgtaacttcggaagctacttaaattatcttactgtccgcattcttatcggtaagccaaaagacatgaaaacatccagctattgggtaatccgtaaatttgtaagagactatgttatccagtatcagagtccttacacccatttacagggattattcctgcgtaccacccgcaatataagctgtgtgccaatcaagcattttgagcgtgaagtcggacagtccggctacaccttaaagaagctcatccagctttactcaaatattatgggatactctgttgtcccactgcgcctgtccacttactgcggatacttcttctctatattaagtattctcggcgcactggcaatcgttatccgtaagctcgtaaatcctgcaatggcacttggatggccttccatgatgtgcgccatctgcttcttctccggacttatcatgttatttatggggaccatcggagaatacctgggcagaatgttccttggaatgaataaacagccgcagttcgttgtgcgggaagtgattacacaaaataatgcacctgataccgaaaaaaccggaatcaatacatctactgtggaagaatctcaaactactagtagttctgacatagaaaagttgtagatactaatcccaggtcctacaaacatttctaatttggcagattcttctgcggcagaacaataaagaattaatatctaaattattttttaactgttcaactaaacataaataacttattataaacagatagtctattgcactaaaaaagacatatcagcttctatctattattatatagtatgggttgaaccgttgtatcacaaatcataatctatcaggaggtactatcatcatgaagaaaattatgattctcggagctggcatctaccaggttcctttaattaaaacagcaaagaaattaggattatacactatcgtagtcagcattcctggaaactatcctggatttgagttagctgacaaagtatattatgagaacaccgtcgatgatgaaaagattcttgaaatcgcaaaagaagaacagattgacggtatcatcacaactggaactgacgtgtgtgttatcacaatcggtaaagtctgcgatgctatgggacttgccggtctttcctatgaagccgctcagattgcagtagacaagatgcttatgaagaccaaatacgaagaatacggtgtccgcaccgctcgtttccgcaaagttcttttcagtgacccggatattaagaaaacaattgaaggcttagagttcccactgattttcaaatctgtagactcctcaggaagccgtggaattacccgggtagactcctacgacaagttcgattccgctatgaactatgtgaaagaaaatacaagaaaagactatttcttaatcgaagaattcgtagaaggcgaagaattcggtgcacaggcatttgtatacaatggggaagtacagttcattcttcctcacggagactatgtattccacggagatactggtgtcccaatcggtcactttgctccatacaacttaaacgaagacgtaatcgaagatgccaaagaacagcttcgcggtgcagtaaaagcaatgcagcttgacaactgcgctatcaacgccgacttcatcttaaaagacaataaaacctatgtattagaactcggcggccgctgcggtgcaacctgcctcgcagagttaacatccatttactacggatttgactactacgaaaaaattcttagaactgcacttggagaaaaccctcacttcacatttgacaaaccattcgtaccgaatgccagccaccttctcatgagtgataaagatggaatcatcaagtctcaggttgattataatgagccaaatgaagacatttgtgaagttgaatttgactacaaaccaggggatgaggtacataaattccatgtgggaccacatcgtattggtcatattattactaagggagaaactttggaggacgcccagaagttgctgtttgaagcaatggataaggtggaaatcacggtagaataatctgggttgccgcaggcaaaatagacgcgccccaagagacgaaccccagcagaagcaattcggtgaatggtaccataggtttcattaaaataccagtttccattttcaatttcctgatatgtagggtcatcgctttctttataaccggttttcaaaaaactgatacttgaattatcattatggcatgccagaatttcgataaacagaattacaaacccattaaaggattagaataagaaaacattaaataataatttcatctccagtcaaaaacagctctccgagagagaagataccctatatttgtggccttagagcgaggattgaatgtgagccgtttagcgaacattcaacccgcagggatagagtcacaaatatagggtatcttctctctcggggagcgtctattttacctgcggcaaactatttctttttaaacatcttcagcactgccatcatctgttttctcaatgcaatcgcagccgcacctaccactaaaaccatcaccgcatagcgataataccatgcgactctgtacagattcatagagagcagattaattgccccataagcaatagcgataagtaccgttttatgaagtggtacgatgaccattcctgtgattttatgctctaagattccctgtacgagcaggagaataatatagctgaacgcagttgtgtaggcggctgccatgtaaccgaagttcaggatacaaacatagtttaagattacatttaataccatcgtcccaattgttcctgcagctacatactgggttcgtttatagtagttctgaagagcagaatagctatagctgtagaatcggaataaagttcccgataccattggagcaataagccagactgccattttatatttagcaccaccgaggattaaaatctcctccggggcgagcattacaaggatccaggagaggattccaaacatgtgcataacagaaatccacggtttggcaacttctttttctgcgccctctccgattttggcataaagccacggaatccaggcattccatacagaatcctcaagtatccagataatgaaagagattgttgtggcaatggcaaatacacccgctgcctctttgctgatcattttctggatcataattttatcggactggttcataatctggatggataaggcttctggaataagcggaagactgaatgccagaccgtatttccagtattttaaattaatgaactttttgccctgtgtccagataacaattgcaacaacagcaccaccgataatctgtggtacatagtatccgataacccggcggtctacaagctgtccgataagcccctggacacgtcctctgtaaataagccatatagacaggaacgttcccggcacgattgtaagcagagttgccatcgtactgaatttatatttgagtacctgtttgtctcttcgctgcacataaagcatacttgtataagtaaatacatacaggaagcaggtgtaaaacatcagatcatccatctgacaaaaatcctgtacctgtgtcttaaatatcatgcacagtccaaagaagaatgcaatggcaatgtaggaaagtgtatgtacgctcgatacataaccattataatcgtcttcaaaatctttcttcgccacatcaacactacgccagaggcagagtgacataatcgtataggcaatcagaagccatgactcgtaggttctgactacaccgtactgtgcctttgtcagcagccttgaataaaccggggttaccgcaaatgtcagcccccttgcaaaaagctgtgccaggatgaagaaaaatcctgaagtaaaggctctcttattcagagaagcatctttatttttcccagccattgtatacctcctaatcctgtaccttacatacaatcatacgaagctttccgttcttatccggtggaatagaatccatccactcgtattcaatctcaaatggatgtttgaacttcgcatttaacttcgctgtcatatctttctcaacttcctcttttgtcagcttagattctgctatattgtgtacgcactggatatgaatcttatgataggtctcctgaatgaaacgcatctgtaaaatgtcctcacaatgagcaataatcggtgcaatttcgaagaatgttgtaacttcgcctgtctcatagcggaagaagtcgttcatacgtccctgtacgcttgtgatatagcggacaccatcacgaacttcgcaggttcccttatcgccaatcgcatagttgatgagcggtaaatctgtcttgtaaagaggcgttacaacgatgttaccttctttggcaggacgattcttttcatcataaatatttacaacaaaagagtcattatgcaccgtatattcttcgctgtcaaaaagtcgtaccattgccgcacctgtctcggcagttccataagaatcaatgattccagggcctaaaatctctgcaaaaagctttcttgcggtatcgtcgatcttctctccagttggacagtagaactttggtttctcaagttctacatgattctgcttacaatataaacagatacgcataaattcactcttattcatatataaaaagtctggcttatatgcattaatctgctttacgatttccggttcaggtgcatactgatttacaaaaccacgacgcaaaatcccgaaatgctgtaaaaatgtatcgctgccaccagaaatactatgggcactcttacggctcatcgtctttcctgtaaatggattataaccggcacacatcataacacggaaccagttcgccatgttgtaggccttttcctttggagaaacgagcagcatcagcggaattcctgaagatccacttgttgtatcgtggaaccagcagtcatacttcggattctttgcttcctcattcatccaggcacgaagctcatccttggtcaataacggaagctttgataaatcatctcctgtgcggatatcttccggcttcactcccgcctcatcaaatctcttcttataaaacggaatctcatatgctctttttacaagcttctgtacacgcttgtcctgtgtgtgcattacccctctaaaatctgtaggaatctttgttttcatcttaaacaaatcaaaaaaaagcagtacatttacaagctttctctctaacttctcaaacatgtcttctcctcttttcttttcggatatctctcttaaagtttttattcccataagacaaatatcaatcacttcattactatagtactatatcagaaatcgactcactgtaaacagtttcatctgttctgtaaatatcttaaatattgtatataagaaaaattattttgtcaactagagcgtgtttggaaaatgctccagagcgtgtttgaaataaaaaaaggcatccctcgtggcaggatgcctcccaaaattactgttatttaatagtaattttaactacttttttaccccgtttgtagttcttagtagcttttgctttaattacaatcttataagtacctttcttgatacctttcttaattgtaaccttaccttttttacttactttaatatactttttagcagatttctttcctctaactttataagttacttttttcctaatagcttttgttttaagattaaacttcttacctttcttcttaatagtagaagccttgtaagttttagcttttgtagaagtcttaatcttctgctttgcttttttaatcttataagttactgttgttgttccatagtagttaccgatgcctttaattgtaattttgtaagtaccggcattcttcttagcactctttttcttctttaaaattatacaatcttttccaacaacaagcttctgaccacttacagtaattactgtaggtaactgttttttcttattgtacgttactgtagcagtagcttttttcttgttaatattagtttgttttacagatggagcagctgcatgaactgctgccggagccattagcattactgcaagaagtactgctgcgattctctttactgtcttcataatttatgcctccttttgacaaaaatctttcggccacgacgaaaaattgtgtccgatttaaatataatcaacatcctctaacaatatgatacacaaatcatgctatctgtagaaatgtaattattactcttttatacctgctttcttttctgtagtatctcctccatagtaagcaccatagtaatcaccatagtaatcaccatatttcttaccataacgattgtaatacttcttatatgccccacttctgatttccgcacgatttaataccgttccaagaaccgggcacccaaccctgtcaagctgctgcaaggactgtcttaccaacgctttggaagtctctccacaacgtacaactaagactgccccatcactcatgctggcaataagcgctccatcagaaatattatccaacggcggtgtatcaataataacatatcgataatcttctgctaatctgtcaagaagttctcctaatctcggatcttccaataaagcagatggattctccagcaatgtagtaaccggaacaatatgtccatttggaatatttgtttcgtagacaacatcttcatactctgccagaccggaaaggaaatggttcagcccttccttaattccttctacttcatacttcttctgtaattcagatttatgtaaatccacatctaccagaacagtaggaaaacctgcctctgaaagaagcttccataaacgtacagaaactgtactctttccttcattaggaatactgcttgtaataacaatcttctttgtattcttaccacagaacttaatatttactcttaaacgattcaaagcctcttctgcagcgtaaggcatatcctttatttttaaattcaacttcttcattacttactaaatcccttctccagcttcccctttttctgctgtttttccgatgccagctcactaacatccggaattactgccaaaggtacaatatcaaagtacttctccatatcatctgctgtatggatcgtatcatccataagatacttcactacaagatacatacagtagaggaacgctcctgctaatgcaccgatcattgtatacttcgtgtagcttgggccatccttataatctgctaatttggctttctgtgcaacgtttggtgcgttcgtactcatcgtcttaggaagatagtcaacagaaacctccataagtgtattcgcaatatctcttgcactctttggatcagtacttactacattaatatttaaaatacgggtatctgtcggattctctaatgtgatcatctttgcaagtgtatcagaatccatatccagattcagtttattgattacctgctctaataccggataacttaacatcaactgctcataatcagctgtcagcgatgtaccgatattcaaagcatctaaatcaactactgaattcttagatgcagatacaacatacatcttcgctgttgacttataagtcggacgaacaagaaaataggaatatgcattcattatcactgctccgatcaaaaagcacagcacaatataatgtatcttgtcaagcaatgcccatgccagatcaatcagatcaatttctgcttcctgctctgttctatccgcaaaactactgcgaacatcctctttacctccggaaatcacttcaaattccggggtactctcctcattcctgttattaataagactcatcttctttcctcattcctgttatttttctactttattaaaaaacagctccatcgctacttcgccacggcttgtttcatccatagtaaattcattaaaaccatcatcttctgcaatagcgttcgttcccttgatagaaagctcgcctttatcttcgctgttcataatcatattggcgacattccccatctctccaacactcatatctgttaccatataatccgagaggtcattataaaattcattaataaatccgctatccgcctgtaactttgctttatacaaagggaacaacgcatcaacatatgccttctgcctgcgcatacggcactcgttcgtaccatctcctacattcattctgtcatgaacataatgcatcgcctgatcatctgtcaatgttatattctgccccattacaagagatggatctgactgggaaaaatcatcttcaatcgtaacaggcacgcctcctgccaaatgattcaatatcttaatcgaatccatgttcaatgaaatatatccttcaatccgaataccgtacagcatatgcgatactgcatccaccgtattctcacaactcagttccattccatcgccttttgcatgtgcaagcgcaatctgtgtcttcgttgtggcaagataagaaccgtcatcatctaatgactttacatctgttatcgtatctctgttaattggaagcttatgatatatattcttcttcgtatcaatcacaagaagctcaagaacatcactctgtccggttccatccgattctgtcttgcctgtcttcacacctctgtcatcttctccaataaaaagatacgtctgcacatcccagttcggcttacacttcacaccgttaatcgtaacaatatctgacgctgccgctgcatccttctgccctgtattcatcttctgattatcaacaatatgcccgatcacaactgttgctgtacagacaataacaaagaccgccaccaccgcagcaagcttctttgcaagcttctccttttcacttctgctatagtacttcttcgccatctaagacacctcagttaaaaaatcccctggagcaaagcacttcctgcacctgggttcgtcttctcacatacaagaagaactgcaagaatcacaaacaagatcacactaataataattgaaactttctttgacatctacttatcctccaaaccaagcagcactgctgcttctttatccattttatcaataaaggtactgcccatcatcttctcaagcgcttcgcgcccattcttaagattcggaactctatgattaagaccatgacagtcacttccaagaaaaatctgttcctttttcctgatcatctttaaaatctgtcttctttcaccccaccgttcaaaacttccagcattaatctgaacataaacaggaagctccatcaactcataaattctcttcttatttcctggaatcatcagaaaacgttccagatgagcgagcataacacgcagcttcctgcgctccaaaatatatctcacttcttcaatctcagacttgttccactttgtaaaaggcatctccagcaaaagaagatccgtaccctcataagtaagttcttctaaacgctccgccctgcttattcctgtaaaaaaagcgacctccactcccattatcagccttggaatcctctcttcttttgtcagttcctggttcattcgttccttcaaacgttcttctgaacaccttcttctgttcaaaaaagaagaaattctgtcttctatagcataaaaatgagacgttgccgccattacatctattccctgtgaagctgagatctgtagcatccccaaagattcctctgaactatggctcccgtcatctatacggggaagcacatgtgaatggaaatctattactgacattctcttttcccttctattctatttactaaataagttacataaaattataaatttttactcttctcaatattttatactataatgtaccaaatttcaatgtcctattctctaataatatccagaaaaatggacaatttctttgcaaaatatacaaaatttgatttgtgagactgcaaggcagaccaaacagacgaacctgggaagataaataaaccataactatctgaatcctttctcaaatttctcaaaaataaattctgactttccccaagccccaaagacagttcctttgcctgcggcaaatcaaaatttcagcagaatcatattccacagcggtgttgtgattaatgatgccgctgtggagaatacaactaattttacggagaattcttcttcacagtcatattttgaagcaagaattgttgtagttgctcctgccggcattgccgccaaaattacacttacgcccattacaaggctgtcgatatgcaggagccagcatgggataaatacgcaaaacggtattataagtaaacggataaatgtatagaaaagtacatctttatcaataatcgttttgggatctgcgtctgcgagaatcattccgatgacgagcatggacattgctgtgttacagttacttacggaagtaattgtttcttctaagaaatgtggaggccgccatccggtaagcatgaggacgataccaatctcacaggcaatgatacatggatgggtaaagattttcttgagcatttcctttttggttggtgcttcggtgaatacggaaacgccctctgaccacatcataattcgctgtggaataaggtaaatagatgctaatgtcagtcccatcattccaaaaacaccctgtgcgattggattccctaaaaatcccgcattagaacaaatcgttgcataacgcaaacatttttttctttttacggagcatttgttatatagtacgcctcctaaaataacacaaaaaacctgaattaatatagaaataacaagaatgactacaaagtcctgtgcgatttttgacgagaactttatcataaaagaataaataatattacacggtaaaataagatcaataacaagattggtcatacctttctgtacttcttttccgacaactcccacctttttcaaaatcagccctgtgatgatgagggcgaacatcattaattgtaagttaattaattccttcacttttgtgtctctccgtttctctgtttatttaatgtatttgtaaatcggcacataagactactatttatattgctatagcttctatgtcgtgacatcctcccccacctgtagaggttgagacttcccaacctcggcaagtttggttctcgttcgataacactactgtgctaagcataagcgagctatccccgtgtgtcccacggttgtgttatattgtattaaggtcatgcatttaccagccgcattccctcatttctgatatttatagccgcatttacatctctgtcatgatgggtcccacactgtggacaatcccactctcttaacgcaagatttttcgtttttgcatttttgtaaccacaaacagaacaggtctggctgcttgcaaaaaatctatccaccttcacaagtttcttcccctgctcctccagtttgtatctcaaaaatgttgtgaacattccccagccgttatccgaaacagatttcccaaaatttagtgaccgcgacatcgctttcatatctaaatcttctatacatacgcaatcataggcattggttatctgtcttgactgcttatgtagaaaatcttttcgttgattggaaaccttttcgtgaagttttgccactttaatcctctgcttattgcgattgtttgaacctttctgcattctggaaagcttacgttgttctctcgctaattttttctctgcatttctgtaataccctggatagacaggttctttaccattgctgtcacgatataattcatgcatggaaaaatctaaacctaaaaaattttgcagttccttttcctgtacttgatcttcatacccaaaaagaatacttgcatagtattttccgcttggtgtctgacttactgttacagatttcagtctgtattcctctggaataatcctgtgctgttttaagcggacttgaccaatcttaggtaatctcaaatatccattagacagagttatgttcccattgatgcagaccgtggaatagctgcttttattccgcttttttgatttgaaccgtggaaaacctgttttcggctgtttgaaaaagttctgaaatgccgtatcaagatgcctgagcgcttgttgtaatgcgatgctatctacttcctttaaaaatccgtattcttctgttttcttcattgcagccatttcttttgcacaaatggtatatgttacgtttgtcttgttctcctcatactgccggatttttctatcaagccaatgattgtataccattctcacacagccgaaagtcttagcaaacaaaatcttctgttcatcattgggatatattctgaatttatatgctctgtttgccaccatgccacttccttttcctcgaaaacccacctttgatacttgaatacaagcgcaagatgatagtatagtaagaatactaaatgtgcgttattatctcaattttttattatccgactaaagatactatactataattaggatgctctatcaagcaggtagcagacgcaattcatctcccaccttagaggtcggagtcttcttgctgtaagaggataaaatttacattccaatatactttatatgccaaatatcccatgcagtcaagtatgtgcagatttttgtacaaacagaaactcccaagcatattaaaaaatgcattctataaaatgaatttattttctttttcattttaagatgaccggcaggcaaacttatgttattatagtttttgggattattacttttaattattttatcgttatttatggagggtatttttttgagtaatgtacattggaggaacattatgacagaaaaactggaaaaactaaaacaaggctatgcgaacttaagcgaatggttagaacatatcatggccgccatcgttctcatcgccattgtcattgctatctgctctttatgggcaccatttaaggaattcctgcagactcgctctgaatcaggggcctttcttaaatatatggcaagcgtatttgatatcgttatcggtattgagtttttcaaactcttatgcaaaccccggaaggatacgatgctcgaagttctcatgttcgtaatcgcacgacatatgattattgaacatacaacggcatttgagaatctgctttctattgttgctatttccattctgattatcgttgaccgatatttcctaaagtcaaaaacgttgaattaaataggaatttgccggggtgggtaaacagacgaacccccagagagaatataccctatatctgtgtctttagtcgcggcggtttgaattctcgcttatgcgttcgtatccaaaccttgctccgaggccacagatatagggtatattctctctgggggttctggttgtttcaattcagcaaatttgttgaaaaatttgtggaagaagacaggagagatagaaataatccgggaaattaaatctctcaggattgacatactattaattaataagaaaaaagagtatattatcggtgtactattaccaataatccattctcagcaaaaatatcatatattcatctgttttgatgtgttttcagcatactacaacacaataatctgtgtatccgtcctttagaaattaaattttacaggattgatacaaaacctaataaaaaaatcaaattttcagcgtactacaacaataattcgggtcaatctttcaaaaaaactccacaggaagccaaaaccttctggcgattccccaaatcactccaacaataaatagcaattttccttccacagccaaagcacagcccccgaagagagtctaacccctatatttgtggcctcggagcaaggtttggatgcgagtacttaaagcgagcattcaaaccgcagcgactaaagtcacaaatataggggttagactctcttcggaggcgtctctttgcctgcggcaaattcctatttattatatccctgaggattattcttctgccaattccatgtatcccggcacatatcctctaatgttctctgagtcttccatccaagaatcttctctgccttttctgcatttgcccagaattctggaagatcaccagctcttctgtcaccaatctcatacttaatcttaatgtcatttgcagattcaaatgcatggatgatctctaatacactgtaaggtgtacctgttcctaagttaaatacttccacacctttatgctgtgcagcgtattctactgcctttaaatgaccatttgccagatccattacatggatataatcacgacggcatgttccatcctttgtaggataatctccgccataaacagtcagatgatctcttcttcctactgctacctgtgcgatatatggcatcaggttgttaggaataccctgtggatcttcacccattcttccagattcatgtgctccgattgggttaaagtaacgaagaagaactactgtaagttcctcgtcagctttcgctgcatcttcaagaatctcctccatcataacctttgtccatccataagggttagaacagctacctctcttcattgtctcgatgtaaggaatatcattctcctcaccataaactgttgcggaagatgagaatacgaacttctttactcctgcttctttcatacactctaataaagtaagggttgtatcaatattatttctgtaatattcgattggtttctgaacagactcaccaactgctttaagacctgcgaaatgaataacacagtcaatcttattctctgcaaaaatctttgccatagctactttatcttttacatctgcctcataagaaacaactttcttaccagaaacttcttcaacacgattcactgcttctgcacagctattacagtaattatctacgataactacgtcatgtcctgctgttaataattccactgctgtatgagaaccaatgtagccagctccccctgctaataaaatattcatcccaaaaactcctcttaaatactttataaatttaacagtttcttttcatcagatggcaacgataattgtcgtttgctccatctggtaaaagtttaccgcaaagtttagtaaaaatcaagaggaagtaagagaatttctgatttgtcaggctgcggagcagacgaactcctgaagcgaaataaagcatatttgtgactttagtcgcagtggtttgaatgttcgcttacagcgctcacatccaaaccttgctccgaggccacaaatatgctttatttcgcttcaggagttctgtgcgctggcagctcagaaaaccagtcggagagatttggggaagaggacagaatatgtagaagttccgggaaatgaaattctataggattgacacttgaaccagtgccataatcgtataaaaatcacaacctgttgaagtctccctcaaatctttctcaaaataaattctgagtttgaataggtagccaaagacagctctcagtaaataaaataacctatatttgtggcctcggagcaagggttggatacgagcgtgtgtaagcgagtattcaaaccgccgcgactaaagtcacaaatataggttattttatttactgagagcgtctcctttgcctgcgcaaatcagaatacatccaaatctttgccattaaccacataaccttcatagccagcctctcgtatctcgtcaagaatagcttcatccctccatgccatttccgctgcaagattcttacgattatcctgaatattcatatgataaatacggtggtaggttacgagaagctttggattggctttttttgcaacctgggcgaggtctgtgcttaatgtatgcacctcgcggtgatatttccgccattttggttcacggcaggatattccggcggcatattctacttcgtgaagaagaatgtcgcagtctttggctttttctgccacgatatcaagtggggctgtatcgcctgtaatcacaatagttttatctggtgttataaacttgtatccataacattctaaagttccgtgacttacaggaaatgcctctactgttacacggtcatctttataaataattccagactcgatttctgtgacttccactcggtatcccgattcatttgccttttcaaatccgttaattcggaaatcaatatcagtctcataggcttttaagatatgatctgtcatatgctgcattcccttagggccaaatactttgagtggaaccggacgctctaatacccacggggtaaaaatgaggtctggatatccggcagtgtggtctgtatgcagatgtgtacagaatgccactgttaaaagatctggtcttaacgcatcaattccattaaagtaagctgcggaagcctgtctgactactcccggcccaaagtctacaatatatgccctgtctcctacaactactgcggaagacggaccatttgcattcgggcaggcattaggtgtgcctgtacctaaaagaacaagttttgttttcattttattgtatccttctctattttgtattttatatcttttatcttaatttatattatgctttccctacattttcaattgctaactatatagcaaattggtatgcgataacatttactatcacttctttactttctgtatctagattccattatgtctccattttaatgacaaataccagctggctgaagttgcaacagctgaatttacattcccatatgtttcgactttaatctaaccagaaatccatactgactttcttctgatattcatttagattccaacatatttctgtacattttctcatgcttaaaattatcagaatactactccgctacttcttccccagaaacatgcttaatagatattccagtaaatccataaataatactgaaaattggtgttaaatacagcaagaacaaatatgggaagaatgcagcccaggctacaccaagtgttcctgccatatatacgccatagccatgccatggaatcattgggcctgccattgttcctgaatcttcaagacagcgggaaaggatttccggtgccacttttctttctttaaatactggtgccattaagcggcctgtcagtacatgagacattggctgggagcagctgatcaaacttgtgatatagccaacaattaaagtaactaaaatcatagaaccatcactgttaatacgctttacaaccgcatttaaaatgtgctctaatacgccgagtttttcaagcatacctcccataccaacagcaaaactgatgatggcaacgtactgtaacatacttcccataccaccacgatttaagatggactgaagtaccccttcctcaattgtagttgtatatccactatatgcagtctgaataatactctgtaatgtcgcatgctgtacaaaaaatgaaactgctcctgctgcaaaacttgaaattccaagtgcagagattgcatttaccttacaaagtaaaagcacgataattaagattgcaggaattaatgttaccgctccaagatggaattctccatttaattctgtaatatagtttgaaatatctcctgctgtataaccaccgcttgtctgctggattcctaaaacagtaaagataattaatgtaatgatatatgtaggaatcgttgtccaaaacatggcacggatatgatcacctaactttgcacctgcaacagctggagctaagtttgttgtatcagaaagcgggcttaacttatcaccaaacattgcaccacagataactgctccggcaaccataccagaattaattcccatcgcattgccgattgccatcattgcaacaccagcacttccaacagaaccataagaagttcctgttacaacactaagtacagaacagaataataatgtaagcggcagtaaccatgccgggttaatcatcttaagcccccaggcaataattatcgcgatcgtaccgctctgtaaccaggtaccaatcataacaccaatcgccataagcagacaaagtgttggaacgaccatacgaatcgcatcatatgcgcccgcaacaacattatcatatggaatacgaacaatcttgcaaacaagataaataaaaatccagcttgcaaataagccgatcatcggtccgccagtctttaaacgaatacaaactgcaaccgaaaaaattatcaatacaagcagtaacaatgactgcggtaaattcagtttcttttcttctttcatcacttttctcccattctgtcagattctctactgtcaacaaaacaattacattctatacaaatcgtaaccttttcagaaacaatacttactgtaaatctatatgtaattttatcttcctgtctgtatgaatctttatttcgcctctttaacctattacgatttaatgtgttaaattgcaaaagacgaactatattataacccataataagcgaaaaagcaatgtcctattaatgaatattgcgagatacacaacgggaagatttttctaaccgccgagattacgaacgggaacttcgtaccgtttctgctaatattgatatgattcttgggaagaatcacgagcaggaacaacagattgagaaagagcaaaatttataaatttcctgttttcatactttccaaaaagaggtattatataaaaaaatgcaggaggtatattcaaatgaaagcacataaatattggtcacttggtgcattggcagccatgattggaaccttttataccggctataaaaacatgaaaacagctcacaaatattttgcttgcagctctcttctctgtatgattatggctatctactctggtcataaaatgatttctggtaaatccagaaaaaagaaagatcctgtttctgaagaagcgcacacgataaaccatgagtaccatgacacaacctctctcctatgagataataaccccaggaggttatgttatggataagatcacacacaaaatacgctgtgaacaatggacagctatcgtcaatgaatgtcttgcaaaagtggggttttgtctacagtctgagcaagtcacttatgacttgcattctgcatatccgcattagaaggcatgaacgcctgaagtggatctaacacaagaagctttgcttgaaaactccgaatcgttttttccatctggaatatacggataccatgcacttactttccttaaaaactggatgagaacagcaaaagaaaaatgatatagaaaaagcccagagtttaaattctctgagcttttctcttgtctatagaagtttcgtccacagattttcttttcttatcttctatctggatataccatagtatttcaaacagcaatcataatagttgattattcatggatttctaatggaagattatctggatcatggaaaaatgtcattttctttccggtataatcgtctaaacgtaccggctctgttgctattccttttgcattaagttctttaaccgtatcatcaacgctttttaccttaaatgccagatgcctcaagccaagtgcttccggataatttacacgggccggagcatcttttataataaatagctcaatctcctgctctccacaagctaaatctattttataatcatcccgttcctttcgataattttcccggattatttcaaaccccagtaaatcaacataaaaatgttttgatttctcataatcgcttcctataattgcaatatgatgaattgtgtcaaacattgatttatcctccgttgtttttcctataagtttatcacagtaagatttctatgaaaacacattaattttactattttcaaatgccagcaccacactactccaggcaaggctcttacttttctctctccgatctatcagcagctctctgttatactctccatttttgccaacctttaatttataccgaaacggtaatcctgttgccgttttaaatggatactcctgaaatgcaataacggccttccacagattttcctctgatggcatttcctgtagaaaccgaacctgctcttgtcgaatcttatatttaccccttatcatcgcattccaaataaattttgtattggtatcggaaagatttgcatctagatattttaataaccaattcatattaatggctgcgatattcacacccatgatattacaggttggaataagagatttatctacttttcgttgatattcaccctttatattttcttccttcatttactgtctcctctactccctacatagatccttcttttttgaataccacctgtaccgtcttaaacagaatccttatatcaagtcccattgtccattcgcttatgcactgtttatcgagttttacgacttcttcgaagtctgtgatgttgcttcgtccgcttatctgccacattccggtaagtcccggcttggttgcgaggcgggcacggtgatgaagttcgtatttatcccattcgtctactgttggcgggcgggttccgactaaggacatatcgcctgctaatgtcaatataggaacaacttttttcaaatttagttcataaagaatcagattattaaatcaccctcaaaataagcaaaaaaaagaacctccgatttctcagaagttctcgtccagtccataatttataatttattactcttccaccatttcattgccttctctaactcctcaaatggttgaagttgtatatcgaaataatccatgatgatatggttagaatcatctactggttctaactgttttattcctgttccaaatcggctgccgattccggccgccatgataagtaaggttgttttcacttctttcctcttttcgtttgtaagtaggcttacactttttaattgtgaatttacacttcaggatatttctggaaatggcatccccgtaatatgcccctggtacttatgctctgactgtttatctatttgctgttatctgattgcttctttcatttaatcttcttctatctttatccttcatacccatttggattcttcttctgccatctccaagaatcttcacacatttcttttataccgttttctgctttccagtctaattcttttgctgcctttcctggatcgcagtagcatgtagcaatatcaccgggacggcgatcttttataacatatggaactttcatacctgtagcagcttcaaaattctttacaatatctaatacactatatccttttccggttcctaagttatatattttaaaaccacatttttcatctattttctgaagggctttcacatgaccttttgcgaggtcaactacatgaatatagtcacgtactcctgttccatctggtgtatcatagtcgtttccgaatactcccaattcttttaacttgcctactgctacctgtgttacgtatggcattaaattgttagggattccatttggattctctcccatgagaccgcttttatgggctccaattgggttaaagtaacgaagtagaattatattccaagtttcatctgccttatatatatccataagaatctgctctagcattgatttagaccagccataaggatttgtacatagaccttttggacattcttctgtgatcggtacaaatgcaggatcaccatatacggttgctgaagatgagaaaataatattttttacattgtattctttcaatttctgtaaaaggattaatgttcctgcaatattgttctggtaatactctaatggttttgcgacagattctcctacggacttcaatcctgcaaaatgaatacatgattcaatattttcttttttgaaaatggtatctaaaataactatatctgaaatatcacctttataaaactttacttctttccctgttattctttttactcgatttaatgcttcttcgctggaattactcaaattatcaagaacaacaacttccttattattttctaataactctacacaagtatgacttccgatatatcctgctccacctgttactaatactgccatgatattttcctccgaattatgtcactatgtctttttcgtgtttttataataataaatgctttcttcatcttctacaaaatgaaaaaatattatctagttgcctcttttttattaataatcgaaaccacttcatctacatatgtatgacagatttcttttgtttctgcctctaccataacacgaatcaatggttctgttccagactcccgaacaagaattcttccggtatctcctaatctttctgctacttttgatatcgcagcctgcacatctgcatctgcctgcgctacggctttatcttttaccattacattcacaagaacctgtgggtaaatatgtaaatcctctgtgagctgactcagctttttctttttagccatcataacttccatcatcttcaagctggtaagaattccatcccccgttgatgcatactttgaaaatatgatatgaccggactgttctcctccgatacggcatccgttctttgtcatatattcataaacatatttatctccaactgctgtcttggcatagccaattcccaactcatcaaaagccttgtataggccaaagtttgacataactgtcgttacaactgtattggtaagcagcttacctctttctttcatatatcttccgtagatataaagaatagcatctccatctactacatttcctttttcatctacgcagagacagcggtctgcatctccatcataggcaaatccaacatctaatccattctctactacatacttctgcaatccttcaatgtgtgtcgaacctgcatctctgttaatattcgtaccatctggctctgcattaataacaaatgtctttgctccaagactgtcaaaaatctgttgtgccatgttccaggaactaccattggcacaatccagtccaaccttcattcctttaaaagaatataaaccaagtgaaataaggtatcccatatagcggttacgacctgctgcgtaatccactgtacatccgatggcatccttatgtgcaaaaggaatctcttcatacttccgaccaaatacttccaactcgctatcaagataagcttctacaagattaattgtagcttcatccatcttttctccattgccattaatcagcttgataccattatcatagtatggattatggctggcagaaatcataataccacaatcaaaatcttctgttcttgctacataagccacagaaggagttgttgttacatgcaaaagatacgcatctgcacctgaggctgtaagcccggcaaccaacgcatactcaaacatatagcttgaacggcgtgtatccttaccgatgacaacctttgccggtatatcatcccctctctgtttctttaactgaccataataccagcctaaaaagcggcctaccttacgtgcgtggtctactgtcaaatttacattcgcttcaccgcgaaaaccgtctgttccaaagtattttcccatcttttcctccaagtatttttaatatatctttaattcacttcctaatgggtaccgaaggattcgaaccttcgcttttccccttcatatgttatatcacaacacttcttttttcaattcattccaaatgtttattttaaaattcctagcttattttagaaactctgcttgatactcttattttcaattattcttatttatcttgtatatcacattgttttgaatatacaacatatctaccccgttctctactaaatattgcatcatgcctcttatatacttttgtacatcaattggaaatagcttgtatttcttccctcctcagtgttataatttgctatagtcacagacatcacaacacatatataagtttacaagatttggctttgaaaaagaaaggaatcttttttatcatgttcaattgtcagcccggatatacacttcgaaaaatcaaaggtatcaattatctcttaccttatggtcagcagattgccgatctgaaaaaaggctttgtgctgaatgagaccagtactttcctgtggaatgtacttcagcatcatgaaggtgccgaaccgcagcaactggcagaaatacttgccaggacttatcaactggatgagtcttattatcctgaacttctgaaagatgtgacagattttctgacacagcttacagccatgggaatgatcacagaagatctccacctgatttcaacaatcccttctgtctctatgataatcgcaggaatctgcataaaactatacggttctgcagaactgatttccccaaatttcaaacctttttatcatgaattttcggatgatgatacctcacaggaaatcgaactggtcaccacgcctccgcccagccgttgttacggacaggttcttctgcagaattctgaaatgactgtttttgaaaatcccgaccgttatgttgtcctttttccacagatgcagaatctttacgaagctcatatgctgaaagatagtacttatgtacggatttactgccacccgcaggtttctgaaacaaatatagaaaatttatttcacgccatacggctgtttttcctttttacagcacaaagaaacggactgtttgcaatccactcagcttctgttctctatcagggaaaagcatggctgttttccggtcattccggaatgggaaaatccacacacactgctctgtggcatgagctttttgacacaccgtacttaaatggagacctgaatcttcttggattaaaggaggatcatatcatcgtctatggcatcccctggtgcggaacttccgggatttttactgccgaagcatatgaactcggaggaattgtcctccttgggcgcgacctgcagacagattatctggaagagttaaatccttcggaaaaagtcctccgtgtcatgcagcgcatgatctcccctgcatggactgaacgccagctttcagaaaatcttttctttgccggggaaatcgctgaccgcgtgccggtactacatcttctctgtacaaagaattcttctgccgcctgtgtgatgaaaaataccattgatcaactggagaagctgcaatgaaagaaaaaatactcctgatctggaagcacctgaaacagggaaccctgaaaaaaatgtggaaacagacattatggatctatcagtacggcagacgttactggaaagccatgatcctgtatacactgcttggtctggtcggaacaggtgtctctctggtttccagtctgatttccagagatctggtagatattattaccggacaccagaccgggaaacttgtaagtacctttgccgcaatgatcggcttctctgtcgcaaacattctggtttcgcaggcatccggatatgcctctactttcattaacctgaaggtggactccgaaatcaagaacgacatctttgccaaaatgctggtaactgactgggaatccctgaccgattaccacaccggagatctggtgacacgctggagttccgatgcctccaatatttcaagcggaatcctgaactggattcccaacctgatcatttatacttttcgttttatcagtgcactggcaatcgtgctttattatgaccctactttcgcactttttgctctgcttggaattcccttcagtgctctgctttcaaagccgctgctgaaacgaatgcgtgataacaaccagagaagtgcggctatgaatgcaaagctttatggatttaaccaggaagctttctccaatatccagacgatcaaggctttcgacctgattcacttttatacagagaaactgaaatctcttcagaaagattatgttaacatgagactggacttccagaagatgtccattctgacttctgttctcatgtccattatcggatttatcgtatcctacagctgttatggatggggaatttaccgtgtatggagcaatgcgatcagttacggaactatgaccatgtttctgtctttgtccggtacattgacaagttcagtaaattctctggtaagtctgattccgtcagccatctcactgactatttcggcaggaagactgatggatatcgtggaaatgccgcaggaggactacagtcaggattctgctgtacgcaacttcgaaaagcagcataagtcagaaggaatcggtctgaacatgcaggatctcagttatacctatcataatggtactgctgttttcgccaatgcttccatagaggcttatcctcatgagatcgtggctctggtaggaccttccggtgaaggtaagacaactatgctgcgcctgatcctgtctcttctgacaccgcaggagggttcttctcatatatgtgccggaacagatcatgaacacatgattgatatgtccccttctacaaggaagttattctcctatgtgccacagggaaatacaatgttttcaggaacaattgcagaaaatatgcgaaatgtgaaacaggatgctacagatgaagaaattattgaagcgctgaaactcgcctgtgcatgggattttgtggaaaaactcccggatggaattgaaagcatcgttaaggaacggggcggaggtttctccgaaggtcaggcacagaggctctccattgccagagcattactgcgcagatcaccgatcctgctgctggatgaggctacctccgcactggatgtaactactgagcgaaaagtcctgcgaaatatcatgcaggatacctaccccagaacctgcattgtaactacacacaggcctacggttctgaatatctgtaacagggtttatgcgatacgggataagaaatgtgagatactaaatgacgtggaaattcatgaaatgatacaaacgttttaaaatcaatttcagggattgagttaaacactctaactcaatcccttttcttgtcaggtggatattctctttagttcacagaataagtaaatcctgtcatcttgagatcatcaatgcttgttccatgattcagatgaactccaatagtcagcgaatttgatactgtacttgcaaatgtgaatgttgcagtcttacctgaacaggatgcctgcacagaagcattatctgtctcaacctgatctactgtatcattaaaagtgatatttaaagtaatggttccattaatacctgaccagtctgccattgccagacccttgccgccattagttccccatctgtcccatacaccatgatatactacatttaattttcccttggcaccacttgctgcataaacaccctctgccattcctgcgtcaacagttactaccggcttcttatatgttttcataattaattatcctttcctgaaatatgacctttacattggttttatctttctctttatcctatctatatcccctcagaaagtcaagtattcttacacaaaacatactgattttttattttattacgacaggaaaacactttctgttgtccttttgttttcttaatgttataatacgcctgttcagaactttatttctgaacaggcgtattataacaggaataaggacagatactatgaataacacaacatcagacccagttaaaatcgatctggaacagcttctccgggagggaaatattatccgcatcaagcctcagggttacagcatgtaccctctctttattcccggacgggatgaagcactgatccagcagacagacggcacagactgccacaggaatgatgtagtcctctacaggcgtgatcagggtatcctcgtgcttcaccgcatctgccggataacatctgacggcttttatatggtgggtgacaaccaatacgaagtggaaggtcctctgcgtcaggatcagattatcggaaaactgattgctgtaaatcgtaacagcagagaatttactgtaggaaatcctttctacaaatttgtttcttccctgtggctttttatgctgcctgttcgccccttctgttttaaactgtcagcatttctcagaaagcttcatcactcatgatcatccatttttcataggagaattccttttttctgcaaagtcaggactacattccttacatcttcaagaacctcagcaggctctatctcatactcttctgctaccagttgtgtcagttcataaacattctctgcccgttccgcgtgcatataaataaagcctgccgtttcgctcaatgagatcacctcattgacttcttctgttcttcttcctgacggaagtacgagatattcatcctccagtctcctgactacataaccttctgtctttttcattttccctttttctcttccttttcctttatttccacgcaataacatgatatacttactattatttattactgccattcaatctctgaacggtaccaattttacgcactttcgggagactcctatggaacgaatatacaatacctatctgaaaataataaaaaatatctgcaccggttctgatcattctgtttccgtacatccggaagaccttcctgctctggcaaaactggcgcaggaacattgtactgtcccatttgtactgccatatctccggtctgcttctgtctatcctgccatgaagcagcaggtaaaaggcatgatgctgaattattatcagattgagcatttcacccggcttaccgtctctcttttaagaaagaacaatattgactgttatcttctgaagggtctgagtctggctgactgctatccggttcctgaatatcgtaagcttggagatcttgacctgtatctggctgatccttctgacctcaccagagcacaggcaattcttgaaagcaacggatatatctctgaggatgaactcagtgaccaccatgtaacctaccgttatatattttccaaaaccgggcgccgttttctcctggagcttcactatcgtgtagttggccagtaccagtacagccccgccaacaaacttgtggattctgtcttctcaccgaaatgtctgaaggcatccacccagacaatccacggatatacttacacagtcctgccgcctacagaatatactttctatatgattcatcatatgctgaagcattatctgtacagcggattcggtatccgccttctctgtgattttaccttttatctgaagcgtcatgaaaaagaaatcaatttccggcagattcatgaatggtgcagagaatcccgcatcatccatctgtacgaaatcattctggaatgctgcaggaaatatctaggtcttccggattctatagacgcccggacacagtacaatccacacgactgccatgatttcataatacagattcttaaagacggcgatatgggaaccgatatttcccagtcactggttggaagcagttcgtatcagaaggttaacttccttacttatttcaaagaaggacacatccagatgaaggtccgctttccaaaagccagccattatccagtcctctggcctgcactctggtgtatcacatttatctgttttatccgcaacacttacacagtacgaaatacaacattccaccagacccttcacagctttaagaaaatcaatcagaagacaaaattaatccatatttttgaaaacagtgacttctgaccaggagccactgtctttactttttccttagtccagtatcagaaagtctttcatctacccggcaggaaaccaagatctttattcccacagacatcaacagataccatctccatttcattcccaatgaaaatgtccggatcataatcttccacaatttttgcgtgatctgcagttttttccttctgtctgccaactctgtaaaagcctttctccccatcggattgcttccatatttcttaagaacctttctgacagcccacagagattttttatgctgcatatattccatttttccgtcaaaaaatgccgcaaaaataagcaaatatccaatcagtgaagtatattctttcggatccttgtcttctttctctatccagcttttcagttcatatacaagtttgaaccagttttctacagaatccggacgatactgccaggaaactgacatatcattttttctgtaaatataccctatatcttccagaaatgcatacttcgcatcacagatataacattgcatattaaacagtttatcttctgcataagaaagatccgcaaaataaatctgatgatttctcaggaactctcttctgtataatttcccccacgcataagaaagtgttcctactgagaaaaatccctgaaatctaaattcttcagatgatggactacataatgcaaatgattgatgtttagtagccggcaatattttatctttccacaatcttgcataattgctgacaacaatatccgcatctgtctgctctgcaagatttatatatttacagaatatctccttatcaggaagataatcatctgcatcggcaaacacaatgtagtcacccttcgcaagcttcagccctctgtttcttgaagctcctggaccctttcccgatccttcaatcatatggatctccgggtattttgcttcatatttctgtataatatcaggacttctatcctttgatccattatctatcaatataatttccagatttttataactctgctttataatactgtccagagtttctctgatgtacttttctgcattgtatacgggtatgatcacagaaatctttttctgctgtttttccaaagctgtcatcttttatctcctgtaaaaactttttctacaatttttttcagtaaattccataatactttccactctgcagttctcctgtaagcaaaccacaataaaatattcggcacaatcaggcagattcccagtctgcataccagaatcataaatgcctgtccggaaataaatctgcaaaaatattccgttattccccatactgcagccatcacccccagatatcctgcatattttacaaagaaaccggtaacaggctttttcagtctgtatttataaatcacatagggttctacccatacagaagtaagtactgtactgcagaatgtacctgcaaatactcctgccacaccaaaatatgtaaccagcagaatggaaattaccagatttaacactgcttcagctatcgctttgtaccgatcattccagaacagtcccatagattccttaaaaatcagcactgcacgtctcatcccattaataaaaaaattaatacacagtatcaaaacaatttcctttggaaataaatattttttaccaaatgccagcttcacaaaaggattcagcagttccagcaaacagacacctgcaaaaccaaacagccagtaccctataaaaaacagactgtcaaaaatccgtcctatcttttcgttctcttccgtcacaccaagatttcccacacttgccgcaactcccagcattgcctgctccagaacctgcctgactgatcctatgatcagataataattggaataaatccctgcactgataattcccacaaaacttgagatcagcagattatctgtattatttactactacattaccaattttatgcatcagcattgcctttacattccttaaaatatcatgacgttcttcctgtggaagctgctccttacacggttctttcagatatgggaacagcctgtctgcctttcgggacatacagatatttccgattatggtacatacaaccgcaataacaagaaacaggataaagtttcgtgtcaaaaacaataccataatctgaaggatatcttgtagtacaagaaaaccattatgatacatcaccgtaatataattcatctgatgggcatctaccagtgtttttttataaatcaataaatacgaaacaacggaattaagcagatacagaagataaattataatcagatgattcacatctggacgatccttcatcaaaatatccagaaatggtatcaggcataagccggcaagcagaacaaagcccgctgttatcctgtagaaattccgaaacatccgcatcagaatctgttgtttttttatatctcttctggctataggagcgtaaagagcatatgtgattgctgttccgaccccaagttctgacaaagacaatatatttaatatatctgtaaacaaaccattaattcctacataaccttcactgagagtcctggtaaaaacaactcttgtaaaaaaacccataaaaattgccaatgtctgtgccaaaaaagctactgtcgtattcataacagaatattctgtccttgatttctgtttcaatcttcacttatcctttcttttcggttataatacattatagtcaattcatagttatatgtatagatatttttaaggagcaaatattcatgaaaaaaaaatcatcaatcatcctgcacagtcttttttttgttgtctgctcggtgctggctgtattatgtctctaccacataatctccatcagacggctaaatgtaaaatacactcctgcaataacagaagaatcctcccgtgaactggacaacccatatcgtggtttctatcagttgagcggatacattctttcagataatcagaagccggagaaatctgctgcctggtgcagaaaaagttgcgcttccaatccatatcctctgatgcttctggagattaatctgaaaaattactccaataccagcataagcacaaatgccaaaaatcagttggataaaatactggaagaatgtgttcaggcaaaaaaacaagttatcctccgttttctgtatgactgggatggacaggctctgtccacggaaccatctgacctgcctcagataaagaatcatatttcccagatttcttctactgtcaacaaatatgcagactgtgtttatattcttcagggtactctgacaggaaatactggagaaatgaatcattccaattacggagatattaatcagataagacagattatagaagaacttaatcagaatatttcctctgatatttttctggcagtccgcactcctggtcagctgcgtggcatactccgcaccagaacacccctgtccagtacagatgccggcaatggcagcctgcaggcaagactcagtctttttaatgacggcatgcttggttctgtttatgatctgggtacttacgatgatacccctttacagccggacagtaatctggatgagcaaggcacacgaagtgaggaacttcttttccagtacaaactctgccaatatgttcctaatgggggtgaggttacagttgataatgaatataacgatctggacaatgcgattgccgacctttcacagatgcatatatcttacctgaattccgaacacgatcccgcagttctggataaatggaagaattccacttatacaggatcacggacagacgttttttccggatgtacagggtacgattatataagtacacaccttggttatcggtatgttatgaaagaatcctctgttgattttcactccgtcctgagtgacacagcctctctttatataacaattgcaaacacaggattttcttccgcatataccagattcgatactgttctgttcctcactgatgaaagtaccgaaaaatcaaagaaaatagaaacaaatattgacaaccgtaccatagcaggcaatgactgctccacatttaaaacagatctggatatccgttccctgagaaaaggaacttactccatttcactgcgtatggaagatccatacacaaaaaattctatccactttgccaatcaggggcagaaaacagcaagacagttcctgtaggtactcttattcttcactaagataaatttttccacaatgcagacttcccaggtaaagggtgtctgtactgtttttatttgcaaaatgaatgatccgtccatctttttttctctgaagtttcaaggatactctgccctccattaatttaatcactgtttttccacatatcctggttcctgcctggatttttctcatatccatggatatcggaacttctctggtctcattcctgtttttcattatcagaaacaattctgtttcctgaaatacccttccaaacccggtattctcaatttcaaacataaattctgctcttcctcttcgaatcggtttcaactccacagttcgcactacaagccgatatcccaggtgttctcctatatactcatagaggctgtatcccttccatattttcaaattatcaaatccatcccacgatatacttttccataaatccagtgctttcatatcataggtactgtccaaataagtaatatgcatcttttttaactcgttgactatgaactttgcctcatacattctgtcgttctcagtacaggctactacttctccgccacatggcatatcttctgtaagacaattaacaaattccatttcctcttttcttgtccacgcctgtgcccagcctgccgcctccctgagttcagttccaaaggttcccagatgagtcatggaacccagaatcccatcatcaaataatgccagatgcgcatatttcttttgtctgaattctttttcacttctcaaagttctccactgcgccggagtacgtacagcaagatatatctcatctcccaaatactgccgcatacagttccacattcgattgatacactctggtgacagatatctggaatcatgcatttctccccagcttccggcaagcatcccctggaagatgaataccgaatgttgcatatcccggagcaaaccaccaatctgctgtaaatgctccagcacctgttcaaaactatccggctcacattcacgcccttttccttcccgatcataaaccggccgcagaatcacatcttttttgtaatacataaaaaaactgagaatgcttctgatattattcagggcattctcatccagttgcatactgcgatatatactgatatccagcaataccagtgcaagaagttctccatctctcagactccatctcagttcttctggatttatggaatcctgaacaacaaacgtatagattccataccatcctctgcctggattttccaggcagacattactctcgatgagttccacctgttggaatacccagttgtttttattcattatatttttccagctcacgtattttatcctcatccatcttaagaatcttttccctgatccacacagccaggattgaaaacgtcattctgaacatatagagtactggtttcagtccagaatgcatactgactcctgtagtccttacatgcatcactgcgggaatttctctgaccctgaacccaagaagcaacatctgcataagcatatttgcatctggatatttgtcatcaaaattattatatttcgaataaaaacggaaggttctccagtttaatccctgaagaccggtagtcggatctgtaattcttcttccagttcctgttttcaacattatacgaaaccatacaaatgcaatctttttggcaaatgaaaccgaaaatccagaacttccttccatgaatcttgatccaaggacaatatccggcaatttcccattctcatcctctttctgcaattccttatagatttccagaaggttacatacgtcatgctgaccgtctgcatccatttgtataacatagctgtatcctttacgcaccgcatatttataaccaagctgcagaccactcccataacccagattaaatacattggtaatcaccgtatggtttctctttttagtcacatgatttgtcttatcctgagacgcatcattcacgaccagtacatctgcaacctgcgctatctccggctgttccagtttttccagaagcggaacgattgttttttcctcattgtatgccggaataatgatcaggacttctttttttgcttcttttccaacgttttctctgttctccatagatactattctctctcttcttatgctatctcaaacagtttcaggatatctccctgttcatcggatatccggactgtagctttttttccatattctctgcatttctcttcatttcccagcagttcggctatcttcctgctgatatcctccggtgaaagctgacacagtataccatccgtcccattctccacctgttctcggtttccgctgcaatcagataccagaatcgtacagcccagaacctgagcttcctgtattgcaatacttttcccctcaaaccgggtcgcatgcacatacagatcacattgcttataatatggataaggattctccttcgcacccagcaacagaaaatcttccttcagtccaagactgtctattttctgctgaagcttatttcgtaattctccctcgcccagaacataccagcgtgcttttatcccctgatccttcaggagcttcatcgcatcaacagctacttcatacgctttctgtgcagtcagccttcccactgtcagtatacgctttctggtgtatgtatcactgaatccaccgggaagttctgattttctgtatatttcctctctgtcgatcagattatggaaaataaaggttttattccggcattccggatatacactgtcaaatacactctttacttcccctgatactgtaaaaatcctgtcaaaatccagataacaatctcggtccagttctctggtgtaaccggcatatttataatcaacatgcaggaatgtgaacttcttcctggccttaacatgatcatggacaaaatatgtagccccaccttccagataagcaactgccatatcatagcttttattcagcttcataccactgtccgacatgacacgccataaaagcttatctgcatatatcttttttctgcccagcatagcaactgcattctttatcagatatggtatatttttaaacaacgccccatgcgtaaacaggcgcataaagacttttttgttcaatttcttctttccctctgctgaaagaactgattctgccgtatagtccctgttcagaatatttacataacccggtacctgactgatcagttctccctgttccagaagcacgtacagatccacctcataccgatccggggtaaatcttttgagcagttccagtaatgccttctctgcgcctgcacctccaagagtattaattacaaacagtacttttttcatatttttatttttctttctctaatttttccagttctttgatgattttctcgtaatcattgtttaataaagaaacctgcatggcaagctcctgatcttttcttttcaggatagaaacctgcgtactgataaaccataatccccacagaacacctgacacaattattatagtcagaatcagtccacgtgtactgacataacgcttcatctgagatggatttaaaagtgcacctgaaagaatcattaatgcagacaaaaacacccatgcaagacaaaatggttctgtcatctttctctttgcaagtgacagaattgccctcacaaccataaacactcctgatacgatcacaaataacctcagtatatctcccacttccatttttttctttcgttcctttcttactattcatatctgtcaaatacttttggtgacggacaatcaccttttttcttcttcagcagatgaccgttacaaaatatatggacatccagatgtttctccatccaccgaagtcttccataagccactgtccatccggcaaagctcccgacaacaagccccgccccataccatatctctgtaaaatgagaagatattatacttcccaccagtgtgataaggcaaaacaccagtcccgtcaatacgcaacccttcatgtcattaaaataatacatgaaaataatctccgcatacatcagaaacaagataaaatatcctgacgccagacagggatatatcctcattgtcattcctccaaaaccaagctgcggaagaaaaatcatacagatcagaaagatcaccagcgtaataataaactgcactctggcaagactcataagctcttcggaaagagcacggaacatccccttctttgtaatatcaatatcagctcctcttccaccgataacggcttctgaatatgctttatatctgccatgaaaatacatctcaactctactgataaagataacacttgcagagatatttgtaaacattgcaagacaggttgccatatcatatgttgtcacacatacaaaagattttactactatcatgtgaagatctgttgtccagaaaacaaaattgtgtacataaagtcctaaaatgtaaagaaaatttgtaaccaccaacggccaatattccttaaaatagaccagaacctgtctgtattttccactgttttccttaaaataactccggactaccgacatttccagacaggcgatcagccaaaatccaattgtcagcgaaaacagcattccatatgtaataccccaatgaaatacttttacaagcagaaaagataaaaacactgtcactgtcataccaacggcaaagaagaatgatatttttttgtaatccttacagatagataggtacaacatagaatagaacacaagaaccagggcaatgtatccgcaataacctgtaaaaacataaataatatccacttttccaaccagatactcccggatacagaatggaattcccacaagagcactcagtgaaatattcaaaagcatgcccacataatagcacggcaaaatatcttcatatgtctcttcatagatcacatctgacatatatttggataatacagagttaaatggagacgacgtaagcagggaaaaaataaatatatacagaaccgtacaggaaaacagttctcttgtaacataacctactgaagagaaatccagaaaatactccatgatcataagcgcaccgatcaccagcagcatgggggcgatcgtaacgaccatactgtatcccgcgcctatgatatcagtagtcagcgtattctttttatagatatttgtaagttttacacctattcctgccatatgtcctctccatcccgtaattgcttatcttatgtttgttatcccgatctcagtcacattatgatttcatttacatcatcttttcatgcacactgatctgaaagggttcctctgtccacgaaagattctgtctgtctgaaaatcctttgtatatttctctgtatacttccttcatctgatcaatcctgtaaagtgcatttacacgtctgtatcctgcttctcccatacaccttctgtctttctcatttacagacatggtaaccattgcatgggcgatctcttctatattcataatgtgtgtgaggattcccgcttccccaaatccgtcattatttccatagatcagttccctgcaatttcccacatctgtggcaattacaggtttgtgagccgcataactctcaaggattgtcaaaggctgtccttcactgatactggtaagcagtgtgaaatccatcttgcccaggtaatcctttacattaacccttcctgtgaattccacatcctgaaccccaagggattctaccagatcataacattcttttgcatattttttatcttcatctgccggtcccataatccagagcttcatattttttactttttttttggcaaaagcaaatgcctgtatcatggttttaacatctttgataggagttacacgaagtacagccccggcattgataaactgcttctcttcttctgtcttgccgggaagatctgcaagcgtctgtgtattgatcccatttggtgtcaccctgatcttctcaggcggacatcccaattccatctgcaggtcctttgcatggtcatacagacaggttaccatatctgccttttcatatgcaagaagtgacatcttcttaaactgttcaatccagatattcttatatactccccttacccaggaagctttgatcagttcttcctccctttctctggtataaatcccatgctcggagatcagtaatgaacttccatgaaaatgttttgccatacttccaagaattccagaataaccggtggccacacaatgatacaaatccgccttcggtacatccattctcagtgcccagaacatcggcagataaatggagcgcagcgtccagaggaaatccgagaaattaatatttgaataattacggtcatagcactccctggcaatcctgaagaaatcctctcccataagaaaagcatctacagaaagatgctttctgtgaaacaggtcaaaaatcacaccccagtctgtcctccggttcagcaccatattcagcatttcgtcatattctttatgagagagatggacttgccttaaagattttctttttctgtttccgctttcccattcacagtcatccagatatacttcataaacctgtgtaaggttttccggcagctcatagacaaatttccccctgaaggatctgttcgccacaattgccagcaatataaattctacattcggaaaagatctgatcagactgttgatccagccggaaacacctccgaccacatatgggtaacagccctctgccacaatacaaactttcatacttttctgctcatttcctctctgtcataacagctatctgtcataatgaagtcctgatgtttttatctgaatcttcacagtagtatcctgcgcctggatcagataagttccatcttctattttcttttctgtaccgccttctatttctgcgatttcttctccatgcgtcctgagaagaaaccagcttcctttctcagaagtttccaacgtaatctcattctctgttctggactctgagaaatccagattcagaaaagttctgattctagtgttgctttctgaaagagtcatactgccaaaacctgtaaagtttttccaataggtgaggatattactggaaaaatgcttctgcataatctgccatctgtcagttttctgctgcggccagaaaatatcatgcatatttaacataacattcgtatatgccagcgaactctggatacttctcatccgaatatcatcactataactgtaattcatcccatcacttgtcacagactgtaaagttacagaatccgtacaataagaaaccaccggctctttctctgtatattcacataccagtgtacttacatttttcaacaattcagtattcatcaatcctgttatcgtatccaaatccctttcttccgcaaaagcagctccatatttataactgctgtccgatttctgaaaaaagtctgcatcctgatccagtttttcccgcaaagaacctgcatttttatactcaagagaaagtcctacttccgcttcctgctctttcatctgcttcaggtaaaatatcatatcttttgtatccggctctataccatcttcataatctgcctgtggctgcataaagcaggtcattttcagctttcctttttctacaatggataccagtgatggccacataatatctctggtcatacctgtcacagactgactgtacagtttcatcatttcttcatcattctcatctgcaaatgccggaaaattaatcattgagagattctgggcatttactaccggataaatataatactcagaagcctctgttatcataccattcaacagtcccagtgctgtgctgtccttcatatagtctcccactatacaaaaaacacttccacccttgattccatttctccacaaaatcgtaggaagatcttcgttctccacctgagttttttgtttactatgatccaaaagtccgaccatatatgttttcgtaccgcttcctacctgataccatggtatctccagctgcagatcctgacgttctttctcttctttttccttcggagtttcatagactacttctccgcccagcagaagaccttcaaaaagtttcacacctgtcagttttgttttctcagacacaaccttataaatccccagaaaatccatcagttcctgatttttttcaatattctttggattttccagacatccaaaaacaatgatcacacctttttgttccagtttctctaatttttccagattatcaccaagtgcatatttctctgattccagtatcagcatccccggcaatgccttatcattctcctggtaatcctccagatttctgcactgtgccatatcccactttgcataaatgcaccatctgcttacggctgtagccatatccgatgaactgtctcccacaaaaagagcatagcttctgtctgttgttctgacagccacaggatctatctgtttaattttccagacatttttaccatctttctgccttgtcgtgaaatttgaatttacatcatatgtgttctgtctgtctctgataaccatagaaaactgaaacaaaaacaaaagaacaaacatcatgattgtaatactgaaaaattttcttttggaaaccattatattaatttttatcctcctgtgtccggaactgattataaccgtaatctattgcaaaattatactgatgatacatattttgtggcattacataacacacaaaatcttctgattcataatataccttcatatcattgggatatctctccttaaatgcctgtgcccagtaatacatccgggacatcagaatccatcttccctctccctgatacatagttattccacctgaatttggtaatgactggctggctgcctttttcgaaatggactgaccactgcctgagtaaagtaccgcataattcagcgggattttttctataaaaaagtatacattctttgtcggaataatcaatttagtgtctttattcatatactccatatttcgaaggaaggtaattgtctcgtaatgccagccatgatcaagccccatctgtgtctcatcatttgctgatacaatcgtccatgtcttgtcttcattttctttaataatattcgacagacacgtcaatgctccattagatacataatctgaaccaaatcccggcattttgatcattccctgatggagcatactcccaacaatgaacacagtcaagataaaagataacacatttcgcggaattgtaaataaacgatgcataaaaatcagataaagaattccatccatcagaactgtcagcgttaatatcagaagatacacataataaatactacatctggcaggatccatcagcatcggaagtccgagccctgatgcacagagcagcaatgtgagaattcccatacagaatcctgctgacataagcatctcaccataagtagtctttcgcaggataataaatatcagaccaagcagaatgacaactgcaattccgataagtaccgcatatgcacaccattgttccggcaagtttatgataaattccccgatacgctgagccatcatattccaggtgttttttattttctccggaatttctctgactttatctgcaaaagtggattcaggagtttccgtcatatttgtctgcattgatttcgcattattacttttaatattattcttcgagttttcattcagacgcgctgccatctcttccatggttatatcctctgaagaagcttcttcatcctcagtatctgatttgccaccattgatgacgcttaatccccagccaagtgagccctgcagaggtgttcctcctgcaaatgcaatccccataggaagcacagccagaaatacactgataataccagtcatcataattcgtttaaaatactctttattcaggaagcgcggacaaaaaccgacagcaattccaatacagcaaagccctgcaatcatagttccataaaaatgaatcgccagagtcagcgcaaaagccagtgcaaagcatcctgagagcagctttgtttctctggttttcagtttctccttctctgtctgaaaaaaactgatcaggaagtaaacagacggaatcacaaaaatcattccgaattcctggggcagtgatgccccaaaacgactatatgtctgttttgcccagagatttcccaatatatatacaagcactcctgcatatggcagatacaatgatctgcataacaatttcatcacagcaagaagtaccatatgaataaagaatacctgtacaagatagaacacacacagaatcgcatacgtatcaaccctaaaaactgtatgaagataatatatcatacagtgaaatccaaacggatatacaccatcggaaaaaagatttcctctgaccatctcattaatccagttcaaatgtaccggtatatctgaagcacaatatccataagtgagcaacaggtttcttccataaatccagaacaaagctataataactgcccctaccagaatccactgaagcgtattacagattactttgtaataaaacagacggactaagcgttttaatactgcactaatcctgttacagactctgtataaagcccccctcattcccatacttccctgaagtattttcttacagataattcctgtctttatgcagagttctcttagagaaaccctgttcaccctgctccagatcagaatccctggtacagcagtaaacaatacaagtgcccagaaacctgaaatatgcaaaagctggactgcaaacacaatatttataatataaaaatttccaaatgtataacacatcagaaactgctctgacagtcctctgcctgccagtatccgacgaaacataatcgcaggtaacaaaactgttaaacctgtataagcagcaaatatacctgcaaatcttaatataaccagagttgtcattgacatatctgttcatccttttactctacataaatgttctgatcagttcaagggtttcattatcaatcgcaatatccgaatctcgaagttcctgcataacctgaaagaacttctctttctttccacatgagaaatagagtttcatctgacaggtatagctggacaaaactcccggatattgttccattgcccggtcacaccacagtgtgcatttctcataatcctttacttccaacaggcgctggcagaccttttcatagacagtactgctgatttttatcttatcaagttcccaggctttttgcaacacctcctgcatcctctctgccatggaacgctgttccagatttgtaagtacctgctgttccagaatcggattcatatattcaacaagttttatacaattttccacctgctgttcattttcttcctggcataaaagataatctgtctgtactttacttcgaaaatcattcaatacatcctgaagaacagatgctgcataatgggcagtctctgaatcctcgctgtttaatgccagattaatcgccgcaagagaattgcggtaatctcctctgatcacattcagcatcaaagtacgaaggctcttcttatctgtaacttccagggcttcttccaaagagaccatatttctctccatttcctcatcaggacggtggaaattctctttcctgtctttgctaaatacaacgtccgacaaatccataccctgggaagaaaataacttaaaaagcaggaatgacaggaatacaaacgcaggacctgtcaccggacataaaagcatcataactgccttcatccatacacttccgattttttcttttctgcggatataattccagatcagatagaacacaaccacgatcagatttatgatcagcaggaaaataaacagcttcattctctgtgacatactgacatcatctccacgtattctgttttatagccattcttctcaaatctgtcctgtacaataacagcaccctctctggttgtgttagtaagcaggacatacagatttccatcaggcagcattcccatgtaatcactgtccctcatatatccggacatctgctcatccgttttttgatattccgagttctgaacatctactttaattaatacacattctacaagatttttcagttttgccttcatatatgcctgaaccagggactcaaatgcttccggttccaggattctggaattctggctataacgcttctcttccagtgcctgcatatatctctgtgccctgaggactgcattctgaatcagatagctgacgactgtaagaaaattggcttgtccaagggtcattttttcccagcttagtccccacatcataacgatcatctgtacctcttcaccttcgtagattcctcttgccataagtggatactgctcatccattttcttattaatatataccttctgctcttttaatgcatcataaatgtccgtcatctccctgtaacggattgaatttccaagacttctcgccttttgggaacttgcagaaaagatacgggcataatctttactgaccacattatagagggctacatcctttgtcttcataagttttcccagcatttccactgcatagaaaataacctcatccggcatacgctgttccagtcctgctgtaatgctgtaaattttaccgatactgtccttatggtcgatcagctgctgctccatgacctcttttacacggacattactttcattgatatcccggatatccacaatctgtctgtgcaaatgttcttccagttcctgactctctaggcgcatgatacgtatctggtctctcatatatcctactacaagccccaggataaaaagctgtgcgatccagacataagtgttataatctatcagtaccgcaaaactacttctggtatacatctgccggaacatataacctgcaactgctaatattgcagaaaacgtcgcctgctgctgcccatatacaattgcaaatagcagcacatacaaaagaaacggatccagatttgcaaaatattcactgcccacagtcctgttattcatcatgaaaaacggaacaaaacataccagattctcgaaaaacggaaaaagtgtcctgatcagccatttccatttttcataaagcattttccaccatgaaagctttaagtcatccccttcaggaaaacagattcatgtttcttcatataagaaaccatgtcttttatattcttctcaagattaccaaatgcatgaactccaaattctctttcaaaacgattgcccgacaaaacacatcttccattactgtcggaaaaagcgacaatattcgattcgatttccatagctttctgaatcatagctgcaagttttacttcacttactacatcattagaagataaattataaagactatatttgtggttgctggtttttataaactggtaaatatactctactgcatcattttcatagagaagtgaaaatgtatggtctgtttttgccttaatatgcccgtcacacatgcagttcagacacatatctgcacaaatattatttacgtcttttctctctttcggaatattgtagagatgatccagacgcaaagttataatatccagacttctgttgattctgaaattatcgcagatctcttctgcctgtgacagtgcatccgctctgattcccactccggaaaagggttcttcttcctttatatcttccgtgtagtttccattataaatttcatctgaagaaagaaaaatcaatctttttttgttttttactgaataagcaaccagaatattgacaagatgagaaataaaaagaactatctctctttcctccccatcccaacggtaatttgtatcaaacgcacccataagaattgttacatctgcatttacactttccagaatatcattcagattctcgcaatcataagaaaactcgtatttttcaaatactctttcatatttattatgtctatacttatctcccgtcagcagaaaaactctgtgtccctcttttcttagtttcaggatcatactgtttatcagactgcaggaacctccgaccagcagaatattcatttttatacctttcttatcttaattccgtaactcaagtatctctcagatattattttcaaaagatgatttttccgaaaaaacctgttcaaaagcctgattaatttctttttttactttctcaaaatcaatctcatgattactgtcgttaatacagattattttctttttctgtctgagaatacttcgcactaatctgtcattcgtctgctctgcatcataatatccgcatattttctgtacattctccggaacaaattctccactcagtttctgatattcccgcaatacatactggctcacatcttccctatgtctgaacggatgactgcatacatcagacaataattccggttccagctcccataatttctgataagtacttttcttaagaggagacggtccatgtaccgtataaaacccggtaaatcgttgaaaagccagttctaatacattgtacagaaaatacatcggaggatatcctatatgaaaatatgcccatggctgcttctttatattactgcgtttatcaaaatacttcgccagcaacattgtattatttaagtaaatgtatggcattgtcggatcatccacatttgctacatccggctgaagtgctaacatatctatcggtttttcatctttaaaaaaatcttccatataaacgggtttcaacagaaacatatcatcattaaaatagacaaactgttctgttaaccctggaattcgatggaaattccattcaatcgtatgtgaattaaatgtagggagaaatttttgagggataaaatcttcatggcagacaatattcaatttcggatgttttgtattcagccattgaggaatatgtccccatgtgacaaaatgaacctttctcacccatggcgcatatttctccatcccgcgaaaccagtaccggagattatcccaatctctgtaccgttcttttctatcatccgtatttacagatatatccatatctgtgtgtcccagccttgcagtcttttctctcttccattccaggtcatttccatctacccaggtaataacaaaatctatatcctgcgtgttcttatctacttttctcatgtattattccccacatatcactttgtaagcataagtataccatatctgtttagcttattacaaataaaaagaatgctgttttatgagactcttatactcacagaaacagcattcctacctgtcgtttaaattaattttattttctcatacaaactctgaagttcccgcaaagcagggcgtgcaggttgtgggaatgatttttcaaacacattctaaagcagctgccgaagaggacgaatgataatcctgagcacaccgtagtataacttctttttccgattcaacactttcccctggtactttgcgccttcggtttcctgaccgtttgcaagtacctctttgcttttttccatataatctgattctgtttcgtgaatctgctgactcagtttttcgctgtcaattaccagcatcagttccgtatagaatatatacggattgcctacaaacaaggaatcattgatgcattttcgattttacgagaaacgctttaatatattcatgttaatccaatcactcgtaggcaatgaagcagggatttatctctgctttcccattttcttctctattgcttccggaactcggatcaagccaaatcgccatagtatcggataaatatatgaaactcctctaatatctccaagtgccttcggtttcttcacttcttctgaaatcctcttactattttcaaatgccagcaccacactactccaggcaaggctcttacttttctctctccggtctatcagcagctctctgttatactctccgtttttgccaacctttaatttataccgaaacggtaatcctgttgccgttttaaatggatactcctgaaatgcaataacagcctgccacaaattttcctctgagggtatttcctgtagaagccgaacctgctcttgtctattcttatatgtccggcatcgctccgcatttagacttatctctgctgcattataaagccccttaatgtagggcagataggaatgaaccgatgctctggaaagacccgtgagtttcataatctccggaatcttttttcctgactgatgcagatcattgatttctgtacatatatctgatgtgaatacatcggcagtaataagtagcttacggagtttaagcagactaatatttaactcatctgccagtgatcttaaggaatctgcttcttcataggcatctcttaactcttgaagaaaattgttaaattgaagttctggattatattctggtttcttttttggtcttcctgccattttcaactcctatttccatgtgaatccaattgtctcagaactaaaacagaggatcccctgccatcctacaaactaatgctccgatggctatcctctgttttttattttatttttcacttctttgtttttagtaatatctatatccaataatagatgacttcttctattgttccactttaaaaacattatagcacaaatctgaaaactgaaatgcaccctttgtactatacccatgaattcttataaaacaaattcgtctgcctttaaagtttctctttgacaatctacataagcagaaataaatttactccaccgtcacactcttcgccaggttacgtggcttatctacatccaatcccttagctacactgatgtagtatcctaacagctgtaatgggattacagcaagggatgttgcaaagtgtgggtcgattttcgggatgtatacagcgaagtctgtactgtcttcgatgttatactgtccaaaggttgtgagccccataaggtatgcgccacggctacggcattctaccatgttggagatggttttctcgtagaggtctggctgtgtgagtacgccgactacgaggatatcatcttcgatgagggagattgtaccatgttttaattcgccagctgcatatgcttctgagtggatgtagctgatttctttcatctttaagcttccttccatacaaatggcatagtcgattcctcgtcctacgaagaagacatcatgtgcgtttgcctgtttggatgcgaaccactggatgcgttctttgtcttcgagaatcttggcgatcttgtctgggattgtctgtaattcggcaatcatatttttatatgtttcatcagagatttctccacgtacttttgcgaactgaagggcaagtatgtaggttgccatgagctgtgtgctgtaggcttttgttgttgctacggcaatttccggtccggcaagtgtatagaatacggagtctgcttctctggcgatagaggaaccgactacatttacgattgccattgtgcggacacctttttctttggactctctgagtgctgcaaggctgtctgctgtttctcctgactggctgattacgattacaagaccttttggatctaataatggatttctgtaacggaactcggaaccaagttctacacgaacaggaatcttagcaaggtcttcgattacatactgggctgcaattcctacatggtaagcagagccgcaggctacgatgtaaatctggctgatatctttgatttcttcttcggaaagtccaacagaagacaaatcaaactgtccatcctttaatacagaatttaatgtatcacccactacttttggctgttcatggatctctttcatcatgaaatgttcaaagcctgctttttctgctgcttctgcatcccattcgatcgtctttaattctttttcgatttcttcgccgtcaaggttatagaaagtaatctctccctttcttacacaggcaagttccatgtttccgatgtagtatacatttcttgtatactttaagatagctggtacatcggatgcgatgtaggactctccatcttcgattccaagaatcattgggctgtcttttcttgaaacatagatttcttccggataatccttaaacattacagcaagtgcataagaaccacgaatacgaaccattgcatgattaatcgcatcgattggtgttccttcatactttttgtagtagtaatctattaactttactgcaacttcggtatctgtctcagaataaaatacatatcctttgcgagttagtttttcttttaattctaaatagttttcgataattccgttatgtacagctactacattgccgtcatcacttttatgcggatgtgcattgttctcagatggttctccgtgtgtcgcccatctggtatgaccaataccacagcttccttttacggctgttccgttatctgtcttctctgcgagggcttttaaacggccttttgccttcactacctctgtttcattctctccatcgcgtactgcgattccggcagaatcatatccacggtactctaacttggacaggccatctaataaaatcggagctgcctgctgtgctcctgtaaatccaacaattccacacatacttttaattcctttctctgactgttatctggttgcttctttttcattgatgacagcaacaacttcgtccacatatgtatgacagatttcttccgtctctgcctctaccatgacacgaattaatggttctgttccggattcacgaacaaggattcttccggtatctcccaatgctttggcaactttatttacagcagcctgcacatcttcatctgcctgtgccactgccttatcttttacctttacattgaccagaacctgcggataaatatgtaaatcctctgtaagctggctcatctttttctttttagccatcataacttccatcatcttcaggctggtaagaattccatcccccgttgatacatactttgaaaaaatgatatgaccggactgctctcctccgatacggcatccgttctttgtcatatattcatatacatatttatctccaactgctgtcttggcatagccaattcccagctcatcaaaggctttataaagtccaaaattcgacataactgtcgtcacaactgtattggtaagcagcttacctctttccttcatatatcttccgtagatataaagaatcgcatctccatctacgacatttcccttttcatctacacacagacaacggtctgcatctccatcgtaggcaaatccaacatctaatccattctctaccacatatttctgtagtccttcaatatgtgtggaacctgcatctctgttaatatttgttccatctggctctgcattaataatataagtctttgctccaagactgtcaaaaatctgctttgccatattccaggaactaccatttgcacaatccagcccaaccttcattcccttaaaagaatacaaaccaagagagataagatatcccatataacgattacgtcctgctgcataatccaccgtacatccgattgcatccctatgcgcaaaaggaatttcttcatacttctgaccaaacacttctaactcgccatcaagatatgcttctacaagatgaattgtagcctcatccatcttctctccattgccattaatcagcttgataccattatcatagtatggattatggctggcagaaatcatgataccacaatcaaaatcttctgttcttgccacataagccactgatggcgttgttgttacatgcaaaagatacgcatccgcaccagatgctgtaagtcccgcaaccagtgcatactcaaacatatagcttgaacggcgggtatccttaccgatgacaatcttagccggtgcatcatcaccagcctgcttctttaactgtccgtaataccagcctaaaaagcgacctactttacgtgcatggtctactgttaaattcacatttgcttccccacggaagccgtcagttccaaaatattttcccatattttctccccaagtatcttcatttttactctgtttgtaagttactatttattaatttttgaaagagtaaccctgcaagcatactccccaacatacatccaaatccattgtgtatcatatcatcaaactcaaaaagtcctcgacataatacaagctgcaaaacttctataactgctgatgctattaaccccatagcaagtccctgccaccatcttaatcttttataaaaaggaaatggaagcaataaaccaaatgggagaagcaatgcaatattcaaaagattctctttaagcatttccctgctatgatagaaaatcacgtctttccatgaccagaatacttctaattcatatgcatgatatccttgatttttccttgtaaatactgttgattctaaaacaatacaataataagtaaataataaaagccctgcaataatctggactctatttactttaccacatttatacaaaaaaatataaacaaaaaataacaatattaacatgataaaatagcatataatctcaaaactactccacggccggttatgttctataaaaatctgatataaatccattgtgtcctcaaacaattatcccttaacttatttggaagcgtaaaagtattctcctttatatatttattaaaaatacttttatccattgtcattactctaaaaaaatatttactttcatatgttttcgttttatcttatcattttcggcctctcaattcaaccattttttatttattttccctgtaaattccattttattttaagtaactcgttcaaaactctaaatgccacaacaaattctattttaaataacacccaattccattttttatgttttttctttctattttttcattttaattgacattttcatttataactgctattatactaagcgttttaatcgctaacaaaaataactactatataaaacacaatcatatgtactctcgaaacctttttatacttaattttgagagcgtcttaataacaataggagaaaaacatgaaaaaattatccattaccaaaatggcagacaccattattgccaagagaaaagaacagaaactcactcaggcacagcttgcagaaatgaccggcatcaaccgaggcatgattagccgtttagaaagctgtgactacacaccatctatcgaccagcttcaatctattgctgaagtgcttaactttgaagtagttgatttgttcgaagatgacaaagtaacatccagcaagccagttcttgataaaaagtacaatattgctgttgccggtactggttatgtaggactttccattgctacccttctttcccagcacaatcacgtaacagcagttgatatcattccagaaaaagtagatcttattaacaacagaaagtcccctattcaggacgattacattgaaatgtatctcgcagaaaaggaacttgatcttactgctacacttgatggtgaagaagcatacaaaaacgctgactttgttgttattgcagctccaaccaactatgacagcaagaaaaacttctttgactgttctgctgtagaagccgttattgaacttgtattaaaggtaaatccaaatgcaactatgattattaaatcaacaatcccagttggatatactgcatctgtaagggaaaaatacaacacaaagaacatcatcttcagcccagaattcttacgcgaatcaaaagccctttacgataacctctatccatcaagaatcattgtatcctgtgatgaagaatcaagagaaaaagctgaaacatttgccaaacttcttcagcagggtgctatcaaagaaaacattgatactcttttcatgggattcacagaagcagaagctgttaaactctttgccaacacttatcttgcactccgtgtatcttacttcaacgaactcgatacatacgcagaatcaaaaggcttaaatacacaggaaatcattaacggtgtatgtcttgacccacgtatcggtactcactacaacaacccaagctttggatacggcggatattgcttaccaaaagacaccaaacagcttttagcaaacttcaatgatgtgccacagaatatgatttctgccatcgtagaaagcaaccggacaagaaaagactttattgctgaccaggtactaaatatggccggtgcatatgaagcaaacagctcctgggatccaagtaaagagggtgaaaaaatcatcggtgtattccgtcttaccatgaagagtaattccgataacttccgtcagtcttctatccagggtgttatgaagagaatcaaagcaaaaggtgccaaagtaatcatctatgaaccaactttaaagaatggcgaaacattctatggttctgaagtcgtaaatgacttaaagaaattcaaaaagaacagtcaggcaattattgcaaaccgctacgattcttgtcttgatgacgtaaaagataaagtatacacaagagatattttcaaaagagattaataaaaagcaaatgttgatgtatctaacgcttcctatcagagaagtggcaaaaaaatatagtggcaataatagatactcagaaatccggtacttacccgtcaaaaagcaataattaagatatgcaagaaataacaatggagaaaataaaatgaatcacatcgatttaaaaaataaaaccgttttcgttacaggttctgccggctttattggcagtaaccttgttctcgaacttttacgaacacaatctccaatccacatcatcggactggacaacatgaatgactactatgatgtcaacattaaagaatggcgtttaaaagaaattgaaaaatgtgttgctgaacacaatgattccacttacgtcttctacaaagatgaccttgccaacaaagcaatcattgataaaatctttgctgaacataaaccagatatcgttgtaaacctcggagcacaagctggtgtacgctactccatcactaatccagatgcatacatccagtccaatatgattggcttctacaacattctcgaagcctgccgtcattcctatgacaacggagaagaaggcgtagatcatctcgtatatgcatcctcttcctccgtctatggaacaaacaaaaaagttccatacagcacagaagataaagtagataatcctgtatccctctacgcagccacaaagaaatcaaacgaactgatggctcacgcatacagcaaactttataacattccatctaccggtctccgcttcttcaccgtatacggaccagccggcagaccagacatggcatactttggattcacaaataaacttcttaaaggagaaactatccagatcttcaactacggtaactgtaaacgtgacttcacttacgttgatgatatcgtagaaggcgtaaaacgcgttatgcagggtgcacctgaaaagaaaaatggagaagacggactaccaattccaccttatgctgtatacaatatcggaaacagtaatccagaaaacctcttagactttgtcacaatccttcaggaagaattaatccgcgcagaagtactccctgccgattatgacttcgaagcacacaaagaactcgttgctatgcagccaggtgacgtacctgtaacatttgcagatacaagcgcacttgaaagagattatggattcaaaccggatacaagcttgagaacgggacttagacattttgcggaatggtataaggagttttataacgtgtaataggttatgtatttcattagctaatttaaggatgtagggcactgattctacattcttaattagctaatgtaaaactttagatttgttggcaaattgcttataataatcctctgcaagttgaagtatttgaatatctccatttaacgtatccattaacgccctgttcgcctctgcctcctgcatttctccaaatatacatacatcatttaacaaatataaaatatatttaaagcactttccataaatatcaagattagaaaaatctttagaccacttaaacatcgccatcaaaaaacctataacggtagattcaaatagttcatctatatgtacaaaaattggatttttttcatcattatatatatagctgttaatagacttttggtaattgtttcgcaattccacttccgtaccggtataaccatactccttaacaaaatatttctttactatttgaaacattctatgtaaattatatcgctctaaattttgctttaactccccttctgtaaaataatcagggaaatattgcatcatcatttttatcccatattcttcatttttcaaagaactaccaccaaatttaaatattgtataatcatttgatgataccataaatttctctccttccaccttctctatagttactgaaaaatgaaaaataaaatacttacgcagcccttatctgcattttatttctcggatgcatctctcttaatatatctgcctgcttttgagaggaaacatgtatatatatttgtgttgttttaatagaactatgccctaaaatttgttgtacacaactgatatccactccttcttcaatcaaatatgtcgcaaacgaatggcgaaacatatgaggagtaatattacgttcaattttagcctgctttgtatattttttcagcattagcctaatggactgctctgtaaatctactctttctcttatttataaaaaaatatccacacgcatgaatctcttctttgttttccgtataatatctatttaaaagttctataactgattcttctccaatttgaacaatcctctcttttccccctttccccataaatcgtattactccagattccaaattaatattctcaatccttatatttgctatttcataaacccttgctcccgtagcaaaaaagacttcaacaactgctacatcccgtaaaataaatcgctgattcttttccgactctctcagttctttatacatacaattaagtaatttttctatttcctcccgaggaataattcttggcaatacacgttcttccttaaactttgtatgtacacgcctcattggattttcttcaattatctcttcctcttctaaatatgcataaaaaactttcagagatgcaatttttcgtttaaccgttttctgtttatattttttatgcaaataagtaatatatctttctattttttctttcgaaggttcctctccctctataaattctacaaactgacgtaaatcaattctatatgctttcaatgtgttccaatctaactcttttctatattcgcaatattccaaatacatgtttatcgtttcctgtaatttcatatttgtatcctccaaagccttttttgtaagtctagcacaattttaatgatggataatacttaattatctatagaaagaaatttttacgtaatggaggcagaatgtataattcagatactatattaagaaaattaattcaacagctaaaaagttattataattctgaaacagaaggagttactgtaattattggtgctggatgttctttaagaagttcatctgatgatatttcaacagaaggaattgtaaaagacatagttaaaaagcatttaaaagaagatcaggatcttcccgatacatggacagaattatattctttatttgtaaataatgtttggacgggtcaaggtgaacaggatagaatagatttattagcaccttattttaagaatctagagccttctaagggatatttggcaattcgaaacctaattaaaacaggctatataaagaatataattactacaaattttgatcctttgattgatgagattttaaaggacattcctcatagaacatttattgatggtttaaaaaaagaatctttttctgatgataatttttccattaattttgttaaagctcatggtgattttcaacatggaaatcttcgttttgccccagatgaattacgacgattatctcctgaaattgaagcggtcattcattctttaacaaaaggaattgtaatagttgtaggttatagaggtcaggatattggtattatgaacgctttaaatacatcaaaagcacattgtgcattttgggtaagtcctgaaaagcctgatttatatgatcagtattcaaatggcagtattgatacctggatgaagacacgaaattcagagtataattttattaatggagaaaaaggagattttaatgttttatttccattcatagaaagtaaattacaagaagtacctaaacaagagattaaaagtctaaaattatggaagaaaagttctttatataatataatttccacaagcgaacgtgcatcgatagtcttttctaatttactcaaaatagaagatgaaattttaaaagagtatatatggacagtcaaggaaccttatttttgtgtggactctacaactttgttatcaatattaattacggttttacaggataaacttgattttcaaaatgatattacaaatgaaatagaagcactattacttgctactgcattaacaattttttcgcaaatacaaggatatcctatttgtgttgatcaatatatatatattattaaagaaaaatatagatatttgcaaaacattcctcaacctgacgataatttctggagtatattaaaagagcttttggctgaaaaagaaattattgaaaaagaaaagttttttgaaatatctataactgtcgattcaactaaacttttttattatgttttaaaaaaaggcatgttttctaaaatgcaatcattatttatcttgattcagcaaatattactttttcaaaaaacaacttgtgagaaaaaagatataatttcaacatcgcatagaataaaattaattttggaaaattattgtaaagaaatcaagtatagttctacctcaaccaagattttttttgagaatatgactccccaggatgataatgtgttagagggatattttcgtaatataatgaaggctcaaacacgtgaactagtaggtaaatcccgaacatattatataaaacctgatatatatatttattatgaagtagacttagaaaataatcgtcttactagtttatatgacgagttttataacagagctaatacattaacagaagagtttttatcagcagttcaatttaataattttatattacctgacacagttgaaattttaaaaagatttatagtatccgataactcaggtttaataattacaggcgtaagtggaagtggaaaaacgacagctctcgctcattggataaaaaacctacaagcatcagatgaatatttaattcttccattctccggtaaaaatcagttgacgaaaaatggacttcagtctttttctgactggctgagtgaacctttaaaattacaggagataaatgaacttttttgttgccgaaagaaaactctgcttttagtttatgatgcaattaatgaaattccaaatacttttgattttttacaaaatatatataatcagctaatatgttttgttgagaaactatcaacacataaatataataatataaaaatgatactatcacttagaaaagatgtctatatgcaattaaatgataatcatgctgtggaacctagagaaggcatttttttccctacaatattacctaatagagaaatttcgcttacctatgaaattagccctttttcaaaagatcaggcagttaaatttttaatggattctacaaatcaaagtcaagaagtgattactacattatatgatgagttttctggaattttacaaatgcctatttatattaagctttttgcagatgcatttacttcgttttccaatttaaatgaaaataattttggagaattgatatctaggtggtacaaaatattattacagaaaatatcggagaataatacacaccaagacgaattggtagtagtaattaatgaaataattttgtcaaaatatcagtatattgacgagaacgtatatataaaaaatattgctaaacggttaaatttagaggaaaagataattataaaagatgtgaatttatttgctgaggcaggaattttaacatataaaagggtaaccaaagaaataaatttttcgcatgatgtatacgaacagatttttttaacccaatatttaatgaagatagaatatccagaagatttctgctgtaatatattagaaaagcaaatcaatatgcatatattgtcattagcgttaaaagattatttactatttcaaaaagaactaaatcaagaatattattttgaaacattaataaaattcatatctaaaaaccatagtttgttaaataattgtattatcgagaatgcgttattactaaatgaaaatagttcaatagaaaatcattggagtattttatttcaaaaaattgattataatataggtttgaactgtcataagtatattttgcaacttattttagatattcttaatactagaatagataaacatagtttcttttctaactcaactttaaacgaacttcggccgctagttatacaaccaacatatataatgaattcacagaaggatcaggccttttttgaatttattaatgctaaatattggtataccttttcatataaatttgaaaatgatgttttaaaagatgcacaaatatattgcataaatgcgaaaaaattacttctatcatctgattccaatataagtttatgtgatgatataaactttttatatgctatactattaagatatgaagggaaacttgttgaggcagttaacactttacaaaaagttcttcaaaatcaaattaaattttctgttccagataagatctgcaaaacagctcttgaactgggcgctatttacagggaactaactaaatttgatgatgcattaggtttatataaaagtataaaaaaattgtacagagattttcctccgtattgggatacacgtttacaattaaatatgggaattatatacaaaaacaagcaacaagttaaaagtgtaaattataagttaactaaagatgactttaatgatttcaaaattacccaacagttattttttaacgtgtataagtatgcctgttcaacagatgatgtattattaaaattagagattttggcagagttaattgaattatgtgcacttgcacgacattatgagtaagtggcagatagcgagtaccttgactaaattttgaccgccttttggcggtcttattttttctctggctttctgcacttttcaggaagacttgttgaccacggtaacagattttcacagaagctcaagtctgtatcttccatgtgctgtgatatttcttccagtaaatattcaaaatactcatatggtttcaggttgtttgcctttgctgtttctgcaatactataaatgatggcactggactgtgctccccgtatcgtatctataatcagccagtttttccggccgatgcagaagttcttgattgctctttccgccgcattattgtccatcggcacatttccatcttccagaaatacttttaaatatttttcctgattgattgaataactcaatcctcttcctgtcttgctcttttcgagacccttccatctgcttttttctcttttacccacgcaaaataggcctccaccagtggtttcacactactctgtcggcgtttttttcgttcttcaggttttaactcctttaatgtattatctacatggtatatcatctgaatctgttccagtgcctgccatgcaatactgctttttcgactctttgacggaagggcttttacaacttcgtcatatcttcgtcttgcatgtgcccagcatccggctatcgtcagaccctctttttcttctcccagtttgtgatatacctgatagccatctgttacacagatccctttataatcttttaagaatctttccggatggtctgcttttcgcgtcttctggtattcataaaggatcactgcctttttttctttctctcccgttcggtagacccacatataactcttgctcccggcttcccttccatcttttcttaccagaacatgagtctcatctgcatggataacaggactcttgtagatatacttatgaagataatcataaaatacggcaagataccggtctgcacattcgattgtccagttcgccatgttctgacgggtgatggcaagtccatatcgcccgaactctttttccagacgggcaaatggaactgcgttgatgtattttccgttgagtacggccgcctcaagagatggggatacaagacttcctctcagcagacaggctggatgtggggcttttttcatcgtatctccctctttgctggcataaactccaacatgatgttcctctacttctacttttgcagggataaaacggtaccgtttgtatatctcatcaggcagctgtttccagcccgcctttccaaatagatcctccagttctttctctgtcagatagtgttctacttttaccaccggtatcccggaaaggtcttcttctcgttttccttttttctttactggacgtttttttacagtggtttctttttccctttcatccagagcagcaagaacctctgcttcattaaacagtaccagttccccatctacatctgtaaatgccagctgctctggtacaggcatctgttccgtctttcttccaaaacggttctggttcattactgccagctgttccaacacaagctggagtttcccgtcaatctctgatagctgttcctgctgtgtgagaaacaactgaatgagtgtctctttcgaaaaggtattcagtttttcttctgtatatttcatctgcataacagaggccttccctttctaaaactatctttattatagcagaagacagcacttctggcgaatctttcttatccttcttttcgtcagtatgactataaggttttcgttcacaggagccatacctgccacgagaaacggaatgcctctttttttagaaaaacatcatttgtttctttgtacagaacaatcctggcttccagaatacaaagaaaaacagaaaaggaagtgatcttttcccacttggaaagcagtctgaaatttctacgttatgcataaaagttacaaagtataatccggtgcttttttcaatcgtttcacctgctttttgggatgagtcgtgagtccttccataagccagcgaaactgctgctctgtaatagaacgaacttcggattctgtccttggccactgaaactgaccggcttctaaccttttataaagcaggagatatccatcattttcccagaccagccctttgatccggtctgttctccttccacaaaaaagataaagggtatccgcttcgatcgcatcttctcccagataagaacgtatggtatctgccagacggtcaatcccggaacgaagatcagtataaccggtaacaataaagatctttttaaaacaagtagcatcatttagcacgagaaaccacccgtattatcttttccaaaagggattctgaaatatcttcttttatgtggataacaactccatttatttcaatagagatatcggaaggactctccgatctggactgttgagtgatcttttcagggatttcaactacctgctggcatgagacagaattgtcttggacgtgctccagacaggctttacggatacagcgtaaacgataataataattcgattttgagataccttttgtatcacaccattgttcaactgtcatatcctgaggacggttctgacagtctttcactaactgagcccattgttgtaaccgataatctacagcaacagccgtggtgatagaactcatagaaaatgcctcctgtccagtcctaaaagttgagtactgaacttttaagacttttaataatctttaggactattatggcactggttggaggtaaaatccagatacggactatctaccacttactgcctttctcccaaaaagaaatctgcgttatcttgtaaaaaaagaagaacaggcggcttatatataagaaaaaaatgtgaaagtccgcctgtttttttcgtccataaaaaacttttaaaatttctacgttatgcacaaaactataccgtataatctggtgcctttttcaatcgtttcacctgctttttagggagggtagtaagaccttccataaaccatcggaactgttggagagcgcacagtatctgccagacggtcaatccctaaacggaggtctgtatatactgttacaataaatatctttttaaaacaggtcgcatcatttaacatgtgagagtacccagactgtcttttccagtaaagcttcttcggcagaaacaacagtgcctgatgttcgttccattcgtgcgaatctctcgattcgctcaaataactctaatgtacaaagtaagtgctccaccatgcgtaccttgactaaataagactgccttttggcggtctaaaactttgtcaaggtacgcactatctaccacttacgcattaacgctcccactgggttttgtgtttcacaataaaatttcaatttttcaagtatattcatataataaaatcctatttacctgacttgtaaatcagctcatttaaaaggcctattttttctgtacctgatgtggtttgcaacagaattccgatatacacttcacaacttctggatgtgcaaaccaaatatatacaacaatcaaattttgtaagagggtcagaccccttctgtatttatctactcagttgttaattgtcaataaaatgtatgcactaagagccacagtttcccgtggctccagtatattataaatcactaaataagtcagccttatatacaccattctttaacatcttattgaagttatcccttacagacacaacatcttccttataggtcattccataccaggtatcattacttcttaaaacctttacagatatcttgccctgctctaacagttcaccgatgaaagttggaatcagatactctgctttcagtggattttttactacttctttctcaaaaaattccttaaatccttcttcgagtacattcagaaaatctggagttaatccccacatattcatgtaaacaagagaatctgtgtcaatggttactccatctgcttctgcgccattctcagtctttacaatattcccggtttcaataacctctgtcaggttattctctgtatccattttgcaaataccacgagttacaccaccgttatcggataatgtattcttcaatacaaatccagccatacaggatttgctgccattcaccagatattcatgaaccgctttaaatccttcttttccatagtaatcatctgcattgattactatgaatggagtgtcaagtatattcttcgctgcaagcactgcctgtcctgttccccatggtttcgtacgaccttccggcagagtacctggaatatcgttaatatcctgaaaagcataatctacagtcacatcatacttctcacagatttttgcaatacgatttccaatgacctctttaaattcttcttcaatgtccttacggataataaatactatatggttaaaaccggcctcaatcgcatcatgaattgagtaatccatgatgatatggttaaaatcatccactggttctaactgtttgattcctgttccaaatcggctgccgattccggctgccataataagtaaggctgttttcatttctttcctcttttcgtttgtaagtgggcttaccctttccaattgtgagtttacacttcaggttatttctggaaatggtatccccgtaatatgtccttggtacttatgctctggctgttatatgtaaagtccatttcaaatctaactttttcgattccctaccttaagaaaatcttaagagagccagaccccctctagtgtgtaagagggtcagaccccttctgcatcatttggtagtacaaggctaattccttttatatctgagaaattttcaaatgtattttcacacaaatctcttcttaaaattattaaaaattcttccattttagtttcttttgcaatttgtgggtatttgattttttctataaattgaatcatttcttccgaagcatacagcggtagcctattcgcctctaatacaaatgccatctccgcttcaatcttttctatacaatcatgtttaccaatataaaatagctttttggtaaaggcttcaataaatgcattataatacttccttttcatttctcgatcagccgcaatcttctgttcctttatttgtgaattactagttatttttacggctactattgacccaataattgttaatatagtcgttccagctgctattaatgccacaattatttcacttttcacttcttatctccctttatattatttctattaacgtcaacttcacaggaattacaccttcatttcactatctaagttgctacttctgctacgaaatcttcttctttccgatttcttctcctggcacagtcccgcaagctcttgcatattttcactttatcggaagaattttgtaagagggtcagaccccttctaatctctaaacaatgataaatcttattcctccgccagtctctcctggatataagccaattttgcaatcatctcttttgtctcttcaagattcaacaactttgtattattgctgttgaactctgttaaagtatttctttctgcatctccatctttatttttttgtaagagggtcagaccccttctgttcggccctcctaagggattcagccccattcacttttgaactatacaaaattacagatttgaaatatgctctttacactgtatcgtataccctatctctggatgaattaaaacatctaaaattttttcatctattttttgatccttttcaagaatattatcaattctttcagttgcaaattttatatccataataacattattagtagaatcaaaaggaatatctcctgatagttttgttacaaattcttccaaagttgcatcaacataggcatgtagatgctcacccagatattttatattatgtggaacttcaccagaatgaataattgcattacgcgttctgtacattctatacaagtgccacgtaactctttgagcatacttccccacatactcttttacctttttagttgtatcaagctccgctatacaagctatacgacttcttaaaacaggaaaatctcctaaaattccatatatctttttacgttcttccttatattggggtaaaaataacaaataaaatatctttttaatatcacacccaatctcattacttaatcccaaaacctcttcatatttacattttggcaaattatcctttaaacattttataatatcttcaattacagaatacaaatattctttttttaatattggaataacattttttaaaacatactcaaatttatttccttcatttttaggttgacataacacttctattgatgaccataaatttaaaaatccactttttaaatctggcactgccaatgccgtattatgtagctcaattgactttctcaaaagcgaatactccgattccgcattaatcaatagacctgttaataaattatctgatgttgcaccaatttttgcaaaatcagtatcatcgataatattgtaagagaatttatgtgcatttacaaaaataggtgattgttgttcttcaataatcattgccttcttttgaattgaaaaaaatctcttatttccaacaaacttataaaaactaaaaaataaatctaatctattataagcaatttctgcagctatattaggacaaggagctttaatatcttcaaaatacacaattactttgtctttatcttttttaaataatgaaaaatttccatcattattaaaacataatctaatccttttttctaaaatttctttgaatttcaatgctatattagaaactgaaaaataaacagtatacttatgatattcaaaattaaaaatatctaaaaaatcatctacactgctttctgttattttaccattagaaaaaaaatgtttcttaagctcgttatatatataatcggaattatatcccatcgaaagaatttccgaaacccaacatcttatagtagcttcgatctttttcttttgctttggtaacctgacatatttttttattgtatccacacaccaataataatattttccattatcaaaagtcgcattcaaatacgctatggtatcattcttttcctgcttagaacttgaaccaaaagatttcaatattctatcaatgttatcttgtccccaacattcttttataacaatatcacttttaaacgatgcactaaattcctcaaaaactatatctctttggtattctctaacctcatttttctcaaccttttttgtcacggaacaatactctttaattaatccatgagtatttaaaagaggcattctaaacaaatcaaccgtataatcaaacaacatttcttctaatcgctgtgcgaaataaagtattccatcaatttcagaaaaattatcacattttctaggtattgaatatttcatttgtaatcgactcctttttagctacaccatctatctccacatttataacttcgatactatcataaatgcttcttttccatagtagtcatctgcattgataactgcaaatggctcatctcagttttcctcatatttcaacataatccactaaatatatttatgattatatattaccatacaggaaatatttcaacaataatacttataaataaccttgtacgtaaaacaaaattggtatatacacattttccatatagacaaatttatccagagactttactctctggataaacattcttttataatctattactccactgtcacactctttgccaggttacgtggcttatccacttctaatccttttgctacgctgatgtagtatcctaacagctgtaatgggattacagcaagggatgttgcaaagtgtgggtcgattttcgggatgtatacggcgaagtctgtgctgtcttcgacgttatactgaccgaaggttgtgagtcccatgaggtatgcgccacgactgcggcattctaccatgttggagatggttttctcgtagagatctggctgtgtaagtacgccgactacgaggatatcatcttcgatgagggagatcgtaccatgttttaattcgccggctgcgtatgcttctgagtggatgtaactgatttctttcatctttaagcttccttccatacagatggcatagtcgatcccacgtcctacgaagaatacatcgtgtgcgtttgcctgtttggatgcaaaccactgaattcgttctttgtcttcgagaattttagcgattttatctgggattgtctgtaattcggcaatcatgtttttatatgtctcatcggagatttctccgcgtacttttgcgaactggagggcaagtatgtaggttgccatgagctgtgtactgtaagcttttgttgttgctacggcaatttccggtccggcaagtgtgtagaatacggagtctgcttctctggcgatagaggaaccgactacgtttacgattgccattgtgcggacacctttttctttagactctcggagtgctgcaaggctgtcagctgtttctcctgactggctgattacgattacaagaccttttggatctaataatggatttctgtaacggaactcggaaccaagttctacacgaacaggaatcttagcaaggtcttcgattacatactgggctgcaattcctacatggtaagcggagccacaggctacgatgtaaatctggctgatatctttgatttcttcttcggaaagtccaacggaagacaaatcaaactgtccatcctttaatacagaatttaatgtatcacctactacttttggctgttcatggatctctttcatcatgaaatgttcaaagcctgctttttctgctgcttccgcatcccattcgatagtctttaattctttttcgatttcttcgccgtcaaggttatagaaagtgatctcgccctttcttacacaggcaagttccatgtttccgatgtagtatacatttcttgtatactttaagatagctggtacatcggatgcgatgtaggactctccatcttcgattccaagaatcattgggctgtcttttcttgaaacatagatttcttccggataatccttaaacattacagcaagtgcataagaaccccgaatacgaaccattgcatgattaatcgcatcaattggtgttccttcatactttttgtagtagtaatctattaactttactgcaacttcggtatctgtctcagaataaaatacatatcctttacgtgttaatttttcttttaattccaaatagttttcaatgattccgttatgtacagctactacattgccatcatcacttttatgcggatgcgcattgccttcagatggttcaccatgcgtagcccatctcgtatgaccgataccacaacttccgagtacggttgctccgttatctgtcttctctgcgagggcttttaaacggccttttgccttcactacctctgtttcattctctccattacgcactgcaattcctgcagaatcatatccgcgatactctaactttgacaaaccatctaataaaatcggagctgcctgctgtactcctgtaaatccaacaattccacacataattttaatccctttctctggctgttatctggttgcttctttttcattgatgacagcaacaacttcatccacatatgtatgacagatttcttccgtctctgcctctaccataacacgaatcaacggttctgttccggattcccggacaaggattcttccggcatctcctaatgcctcggcaactttattcacagcagcctgtacatcctgatctgcctgtgctaccgctttatcttttacctttacattgaccagaacctgcggataaatatgtaaatcctctgtaagctggctcatctttttctttttagccatcataacttccatcatcttcaggctggtaaggattccgtcccccgttgatgcatactttgaaaaaatgatatgaccggactgttctcctccgatacggcatccgttcttcgtcatatattcataaacatatttatctccaactgctgtcttggcatagccaattcccaactcatcaaaagccttgtataggccaaagtttgacataactgtcgttacaactgtattggtaagcagcttacctctttctttcatatatcttccgtagatataaagaatagcatctccatctactacatttcctttttcatctacgcagagacagcggtctgcatctccatcataggcaaatccaacatctaatccattctctactacatacttctgcaatccttcaatgtgtgtcgaacctgcatctctgttaatattcgtaccatctggctctgcattaataacaaatgtctttgctccaagactgtcaaaaatctgttgtgccatgttccaggaactaccattggcacaatccagtccaaccttcattcctttaaaagaatataaaccaagtgaaataaggtatcccatatagcggttacgacctgctgcgtaatccactgtacatccgatggcatccttatgtgcaaaaggaatctcttcatacttctgaccaaatacttccaactcgctatcaagataagcttctacaagatgaattgtagcttcatccatcttttctccattgccattaatcagcttgataccattatcatagtatggattatggctggcagaaatcataataccacaatcaaaatcttctgttcttgctacataagccacagaaggagttgttattacatgcaaaagatacgcatctgcacctgaggctgtaagcccggcaaccaacgcatactcaaacatatagcttgaacggcgggtatctccttaccgataacaatcttcgctggtgtattgtccccattctgcttttttaattatccataataccagcctaaaaagcggcctaccttacgtgcgtggtctactgtcaaatttacattcgcttctccgcgaaaaccgtctgttccaaagtattttcccatcttttcctccaagtatttttaatatatctttaattcacttcataatgggtaccgaaggattcgaaccttcgcttttccccttcataaatatacaataatcaagtattatatacttatgaaggggaatgctttaaccactaagctaggtaccctattgatttcttacaattatatttgttaattcttaatcttcccaagaaatcaccatttttataatattaattttgttttatcgcttttattaaatctcgtgcttcatttttatttaataaaataaatgcagctccatatacaaccgtaacaacaattcctgttcctattgcatagcaaattaattctatgtaatttattgcattaacacttataatattatgactcgcataaactataataaaaaacagaataaaatcaataataacatttttaaattcatatttagaggaacgattaagaacatgattatttgtataaataatagagtccgttgtcctatatattcctgcaatcgctgtgccaagaagtacacctttcattcctataaagttaaccaaaataagagaacttactaaattaattgcagcttccaatatataacgccatgttgtatcaggagcttttcctgctatattggctgaagccaagcttgcaccacgtgaacactctaacattaagttaaatgaaaatattaacgccgcaatgaaatctatataattaatatcggttatactctgcgtatataattttacaaagttgataattaaaaccatactaatggaggccattatacctcctatcattgactgcattgcactatatgcattgtatactttttcaaaaaatgttttatctttgtggaaggattgtccaaggacaaaacttgtactaccacgaatcaatgaaataatttgagctaatgcagtatataccaagttataagttgcgtaaacacttgcaactttaagaccgcaaaaaactgaaagaacaaatgtatctgtactattaaaaatcaatcctgctatttgctgggtaaaataatactttctattttcaagcagtgactcatctaatcgagcatttttatcaatccatttatatcttctattaaagtatattgcatatattataacctgcactataattacaacaacactcataatctgcataattacaacactaccaaaatatccaatagatactattttagctgcatatgttaatacagttgttaaaagtgtaatcaatgatattacatagtattttccttcagcatttaacaattgttgatacgcagctctaaatgcaaaattaattacaccaactgctccttgcaagataataatcgcaaatgtttcccaatatggaatctccgatgaaattatcagaggatatactactgaaatcaataataccatcatcgcataaaccactgaaatccgatgataataatgttgtgatgttcttataactattgatgtttgctctttgtcatcctgacctacagtcttatatagcgcctgcaatgttgctgtattaaatcctgcctctaacaacgaaaggtaccttaaaatattggttactgaactcaataaaccattatattctgagccccaagctagtaaaataagcctcggaagaatcattccaagaactaaagttattaattgtgtcaatgttgaaactactaaattttctataactgttttctttttcatgaattaccccattataatatctcaataaaatcaattttattttcatgtaattctactactttatattttagcaaaacatctttttagcatttgatttatttttaattcaacaccataatgtaatatagttgcaagaagaatcgcatgcgcaattggtaataatatccacacttccgctgtcatcccctgcatttccatctttcgaataattccaaatccaataaattgatgtgtaagatataatacatacgaaatttccgaaagaaaaataaacgggcgtaatatctgtttcatcccttctgttttttgatttgtcttttctcgagaacacaagattaacatacataaggagaaaataaaaaaaatgaaagtactctcagaacacaagcacttacatacaactgtgcaaatgattaaatatattatcatcattcctttttgttgcaaattttctgtataattcaaataatacaccgcacatcctgctaaaaaaacatacatataatccggaatcataaaaaatataattccccactgcgctggtaaatcaaatggtccaaagcaatatatcaaacatattacttcgattactatacataaccacaaccatttagctttttgttttccttttaatcccccccacatgctataatcgcaaatataatatagaaaattaattcttttggcatagtccagtaaacaccatctatagctgttgagccaaaaagagtggggaacattgtgatattaagaagaaattgcctcactgaaggcactctttcaggaaagataaacgccatatatattgttgtaactaccatacatacccaaaacattggatataaacgcacacatctttttttcaaaaatgacaccatattaaagttttctttatatgtatatactataagaaaaccacttaacataaaaaatgcgtaaactgcatggcatccccaaggaaaggaaaaattatactttgccaagtgtcctatggatttatcatattgtgtggtatagtgatataatacaatcaataacgctgaaagccctctaaaaacatctaatagccacagagaatttattctcttttccatagctggtttattcgttttttccaccattcttttttttcctcccattgcatatgacgtaattcttttaactcatatttttctccataatacggatttatttttttaacatcgtccatcgttgcggatgcggtcttctccgtaaaaccttcagggccgatataaaatgccgttgtagtagatgcatcaaacccttctttattaaacttacgttttttaaaatgaatataaataaattcttctttaaaggattttccatcaatccaatattttctatatatatgtccattttcccaataaaagacttgtttattataatttggatcatccagagccaatctaaaacgtttatatatcatagaaatatccgcaaatattctctcttcaaacatagaaatattattcttatgatatataccatatacaccactccattcatcaaaaagaaaattgcgtggatttgtaacaacttcttcccagtttccgcatgcgctaccatcaagtttataatattctttacactctggtgtattcttgtataatgaaagatgtcctaaatgcaaaaatctatcatatttatttattttatattcactaaaaaatcttctcaaatctccaaaaatcaagtcaacatcgcagtgaccccaatagtcataatcggacaaatagtcttctaaaatatgaccatatagaggtttgaaatcacataatttataaggataatcaatcctaactttcttatgcaattttttttctgctaatttgcgaaattcatcaagagtaatattgataatttttacattatctggtaaatcatcaaatttattatcagttacaataaaaaaatctatcgtttgattgtactcacatgaacgtatccataaatcaaaatagggtggaaattcaccataatacactactaatattgcaattttttccataatatatatccctcaaaatatctaaaattaatagtttctgtaaatctattattccatgataattataagccaaatatggcatataattgatgcaagaatttgtaatattttatagtttcttcaaaatatgtaaaaccaattcactatgtgcttcacattcgacataatttctcaatgtatatttgtacgtactattataagctgcatcaattatagttttttccaaaagacccttagtcagtttattaattattctatataacaatccacgctttattttcataatatttaataagtaaaaatttttatagtattcagctaattcatcataatgttgacctacttttttagaatcagttaattcttcactacgaatattaaactgctctaaaatattttttgcctcattttctttagcaacacgaaccgtatttttattctttttaagaggaatatacttcacttcaaaatcatcagaaatcattatcaataatgatgtttgccagtattcattttcttcatcatcaaataaaaaattaccttgtccatatactatcgttccttgcaaatattcttctctacaacctatacaatgactatgctgacatactactaaatctgctcctttttctactaatttacgacacgttttttgtaagttaggagaaggatatcgatactgttccttacctccatgatacaacacaatcacataatcacattgtttttttaattctactatatgatctggcgtttctaataaatctattggattagctccactttctttttctgtggcaaccgtaaactcatgctcaacacatgcataaatacctatttttttcccttcacaatttattattttaggtttggatgcatccttaattgaattacctacgccaatataagaaatatctgctttttttaatgttttaatagtactatcaagaccttttatcccttgatctaatatatgattattcgcaagtgttaataaatcaatttccattgctttatatgctgaaatgcattgcgttggtgcgataagattcggtccacatttctttatagggctactctcatttaccaatggcacttccaaattaaaaattctataatctgcacttcgaataatatctgtaagttctcttccaattaatgtatcaacatcacctttttcaaataattctatattagatttagtaggaactaaatctgctcctattattatattcatactattcacctattccattggaagttttatccaacttccaatcttataatcccattctattggttcaataggatcaaatccacaaccatcaaaaaaagtcatttcaccaaagaaaattccatttggtgtctgatagaaatctattctaacatgtggtattccttctgataatttttcagctaaacacttcatttcttcaaacttttcaggtttagccggaggaatctttgcatgatcatatccccacacaaaatctaattgttgataattttcatcaaaataatttgcctttgttttttctgaggacattctatctgagttaatcattacaattttaactttaccatcaaaacaataatatttataatcttttaattcataccccgattcatcaaccatatatttttcagcaattattcttcttggtacatttttataaggccattctcttcccgttaaataatagtcctgttccataccttttctaagttcattcttcacttgatttatatctaaattatttttgtttttgcatatgcacataccaagtccggagttgtgattgcatttaagaacaaactgcataggcaatttatcaaaatctattttatccgaatcatcccaaactcctaatagaggaataagatatttttcacctattttttctctaacataatttctaaccaaatatttatctaccatcattgtatattctggttttctattatataatttcatccattgcattttttcattaaaagtttctggtttatttaaattaagttttcttccaaaccttgcacgaaacgctgctttcaaaaaagccttatctggaagccaattaagcatctttctataatttaatgcatcaaatattcgagtatacatttacctctcctcgccttctacctttcttttgtaatactgcataattttcattttttttattgaattctactgcttttgacataaataaaattacaagtccctgctccattgcattgtaagaaacaacagcaaattgcatagcaaacattaaaataaaacatattgtcataacattaagaatctgcgttgcgtgatgttttaaataaattctcaaatattcgtataataacttaatataataaaaataataaataagaaatcccatcccacctactccaactaacatttctataaaattattatgtgaataagtaagatgccctgtcgccgttaaatttataattctaaaattatcaataccataacctagtactgtagatttcttccaagcagcaattccaacatctatatatttttttcgtaacaacgcactgctgtctaccttaccacttttgttaaccaatgctaatgctccttcaattctccatccaatagcattatacaaaacatcattattcatgattaagatatataaaaaatatatactcataaatataacaatcaaattcctaatttttttatttggatgttttaaatagtagaataagctaattcctaataccaccattaaaaaagcttttcttgaagctgtataatataacaaaacaactggaatcaccatagatatcaacacaactattcgctgtattatttttgtgttattattcaaaaaatataacattactattataaataatgcacatttcataccaacatcatttccattccacaatccagtagtggcttccccatgttgtgctaattgaaaactcttaagatctactttgaccaacacataaatcatcataataaataatgatatcaagaataatttcatatatgtttctaattcatcttgtgaatctatttcctcatcaactaaaaataaaataataaataatataactaatgttttaatacagtcaaatgatactgagcgatttatagcataaataatcgaaatggaacacattcccccaaatgatatcagccatattttaaataaattaattttaaaattaattttaaaactatttgctatacttattactgctaaaacagagaaaaaactcaaccaccataatattggatttgcgctccactctggatttaatgctactgaaaagaaaacaacaataacagtataagtaatctgtttatatgatattttcatgctaattctctcctcttacaattttctccataagtttaagccattcttttgcaactttgttacaatcaatttcttttcttaatccataggcagcttgtccatactgcgccgcaatatctttattctccaaatatatattgattgcttctgctaatctttccttatctccacaaggtacgattaatcctctgtcatcacttaataactgtctagctccacctggtgaacaatcagttgaaatacatggaatacccatacacatagcttcaattaacgaatttggtaatccttcaaaatcagaagttagaacaaaacaataagattctttaatccaattcaaaacatcactttttgttcccatcaaatacaccttgtcttttaatccaagttcatcaattctattttgtaatttcttttttaaagatccttcaccaaatatctttaataccacgtccttatgtttattactaactatattaaatgcatctataagtaattcttgatttttttgtggttctaatctagctacagttacaatctcagaataattaatatcttctttcttacgttcaggtattctacttaattccacaggatttaaaataatacttgattttctttgtactttctttgagtagcattgttttgctccttctgtttgaaaaacaatatgagatgcaccaaactctacgattttacgaaatattttatcaactttgctttgattagttttatttggatcatttctttcagagtaaatgattggaatatttttaccagttaatgaaagaattgtataagcacatacatcattcatgaaagaaagaacacaatctgaattttccttatcaacaaaatctctaatagaagagattagtttgaaatgtgacactccatctactctataatcatcataatattctacttttactttctcatttaacctataagcagaaggtttatctgaagaagtaataaatatagaaacatcatgtcccatatcacaccaaatattagagagtattgatattactctttccgctcctccaaaagtcattcctggagtaataaatacaagtttcattactatcaccccttacatgcttttaaatatatttcacaataatctttagccattttatctgcagaaaacttttctgaactgatcactgcattttggccatataattttctatcatctgcagaagaaattaatctttctaagcctgctgcaactccatctactgtaggctcacaaagtaagcccgacttctcattttcaatcatatcaggtataccacccacatttgatgcaagtattggcataccagtacccatggcttctataagtgtcatgggcataccttcaaagagtgatggtaatacaaatatatcactactttccataactgaataaacatcatctgtaagtccacaaaaaaatatattctgatccatatttaagttctttactaattctttgatagcttcttctaattcaccttgcccatacaaatagagagaaacatcactaccgctgttcacaactctagaaaatgcttttactagaacttcatgatttttttgttttgaaaatctacctatatgaagtattctactatttccactatagtcattttttttatgacatttttccatagatacaccattaaaaaccactggtgtgttcttaaaatcgatattatattcatcagctacagatttttgaatttcttcagttaatgaaacaggtactacatggcacttcttgaatagaaaacggttaaaagttctattcatcttaccagcttcatttcgtgcaatattatgtatagtatagattttagcttttataccacatattgatgcagctacatgtgcatactttgcagcataaagatgagaatgtacaacatcaggtttatattctttaaaaatctttaccagtttaaatattaatgataaatctaaaccgctttttttatttaaataaatgattttgattccatttttttccattctttctgtcataatagaatgataatcatataagctaataacagtaacctcatgtcctaacttgattaaactgttagtaagattctcacacattgtttctgcaccagctagatcaagcaatggtattatttgtattattttcatttactatatcctcatcgttatgtaactatctgttgcattttctttctttataatttttgcaggatttcctatgacaatagaatgttctggaacatcagagtttacgtatgcattaggggcaattaatacatcattaccagtatgaatattacctactaccatactgtttgatccaacccaaacaccatcacctaaagtaggtgcacctattctttttccacaattttctcgaccaatagtacatcccttatttagattaaaattctttccaattttagctagaggactcacattaatgttatgagcatgtccaagatataatccagggccaacattatcgcttagaatttctaagccgtattttctagctgctctcattgcgaatagtgtacgaatttttgtcttttttcttctaattaaatatagatatctaatatcatagcgtaatagcatgattaaagtgccttttactggattccatttttcaccagtcatacgataataatcacacttaaaatacttattcattttcttcaccgtcctaattaaaataatgtcttatttgatactattttcctaattctagaacttagagatcagacactggatgacattttctgctctgtatttttctgcttctttcaaacaagatggcttcttggaaagaagcaagtctagattgtttcctacatttatgagtgtatcgataaaagcatagttatcatgaactggatacacgtatccatttttctcattcacaatttctgaattataacgccaatcacttgcgaccactggaacacctgcagccatcgcatcaagaagtgtccctgcaaaaccttctccttcataatatgttggaaaaagtagggcaaaataatttttcaacacctcgacacttttatcaaaaggaaccagtcctccatacttaatgtacgacggaaatgtattctctagctcattaaaccattccgtttgtgcagaatccacctggccataaatatccaaagtgtaaactgttctgccaaagtgttcatttactgttttcacggcatttacagcatcttctattcctttttctttcatgacacgcgaaaaagtacaaaggctatacggctccgtattagggtaaacaagttccgattctttcagaatattcaagtctttaaagttcggcatcacatacacattgttgaatccctgtatttctaatgcttttctcatagtattggtttccacataaatgccatcaaatgacatcaacgctttagtcaaattttttcgcttcttcaaaaactctgttagccaaccaccaattacaacataatgtaaccttctatgaaagaatacattgatagagttacataatggtacaaatatctttataccattatgtgctggaaagattattatgttatcgcatttaataaatgctttgatcatttgaaatactacagatggaagcgatttagctcctccatgagtatcaatttttacaacttgatctgcgccaaactgtttatccaattcttttgttactattttggttttaatagtttgaccattcaataaattttcaccaaatccaaaatgaccaataacacaaacttttttcatatttatcctctttcgtaattcttcttctttaacacaccaaaaaacatattccagcatgtataccatgcagctactactgcaggcttctcatcgcacatatggaacaaatcataatggctcttaaattttcttctaaatttatcatgactaatacttacttttcttactctatatttcgcaagattctctttaagaagatatgcacaagtgcctggtttcttataaagctgtaatctaatcgcatagtcattattcttcttaatatccttaatctgaataagaccaaacactttagtgctatacatcatagtaagctgaccaatataatcatagttatatatcttacgcttattcactttatctggaccagatacataaatattcaatggtttagagtcttcatctatcttttcatattcagtaaatgaaagactataaccatttttgttcataaaatcaatctggtgttctagcttttctggcatccaaagatcatctgaatctagaaaagcaatccattcaccctttgcttctcttaatgctttatttctggttaatgcggctccagaatttttctcattatggaaatacttaattctattatcattaaatgaagccacaatctcatctgtcttatctgtagaacaatcatctacaataagtaactcccaatttgtatatgtctgattaataacagacttaattgtttctgcaataaatctttcagtgttccatgatggcataataattgatactaatccatctatcataattactggtctcctacaatattatttatatactcgctagttgcattatctttaacaattattctcgccggatttcccaacactatcgagtgacttggtacatcaaatttaaataagtatttggtgctattaatacatcattaccaattttaatatttccgactattgtcacattcatcccaatccaaacattatcccctattataggagttccctgtctctttcctcgattttcttgaccaatggttactcccttatggatattacaattcattcctataatacatttatcattaattgttattccgtatggatgtgcgataaataatcctttaccaatcttaacaggataatctatttcaattccatgttttgtaccatgttttaacaacaacaaatgccaaataatttttttccccccacttgcatattggcatcgtctaaaaaaataattccatttttttatatatttatcaactttagaagctccatatcgatacatatctgcttcaaatactgctctccatccagacatctccattatctatattcctttccaagtactgcaaatacagttctaaacatcgtaactatctctcctaagaaagaaaatttcttaatactttgaaggttatacttcatttttcctggaagcacttcttccacataaactcgatccacatcatctgcagcatcaaggagttctgcttcatctttataacgaatactcgcctcacttgtaattcctgccggaagcagaagcgttgccctcatttctttagtgtatttttttacatatttggtcacttccggtcttgttcctacaaaactcatattacctgaaagtacatcaaatacttgaggaagttcatccagacgatactttcggagaaaagctcctgttggtgtaattcgattatctccagaaaccgttactgcagatcctatctgatctgcattagcaaccattgtgcgaaatttatgtattttaaacttttttccataggtagtaactctctcctgtcgataaaatacacctccctttgactctgtagcaattctaattgctatgataatcattggaattgctgtaatcattaaaatacaagttgctgctacaatatcaaaagccctctttaatcttaagcttaacttttttttagaaagtatatcataatactcttttacttcatcacattgcatgaatttaggaagttctttccattttttcatactcaatcctcacatttcctgaaaattcatttataattcttaaatgtactctttcacaatctcactgtatttttcaattacatattcaacttcttcatcagttaattttgtatgtaatggtaatgtgatttcattttcaaatcttttataagcatttggataatctttaatatcaaatccaagattcttataagctgtcatcattggtaatggtttgtaatgtacattacaagctacaccctgctccgccatttttacaataatctcatgacgttgttccagagtaattcccggaattcttgtaatatacagatgtcctgatgactgatgctcctctgtataatgatttaacacttcgatgccaagaggcttaaatgcctcatcatatttcccaataatttcctttcttctttcaagaagtccagcatatctcttcatctgtgctaaaccaattccagcaacaacatctgtcatattgcatttgtaccatggtcctacaatatcatattcccatgctccaagctgggtcttggctaaagcatctttagactgaccatgaagagaaagcaactgatactgatgatagatttcttcattgtcaataccttcaatatctctccatgttgctgctccaccttctgctgttgtaaagttcttaactgcatggaaactaaagtttgaaaaatctgcaatacttccaactggctttccatgccatgtggcaccaaatgcatgtgccgcatcagtcattacaataactcttcctattgcttcctgtaatttgttcacaggatggaatagagactttttagcctctacaatagagaatattttatcataatcacaaggtactcctcctaaatctactggaataattacctttgttttttctgtgattgcttcggccagtttatcataatccatttccagagaatctttctgtacatctacaagaacgatttttgctcctacatgatacacaacagatgcactcgctgtataagtgtacgctggaacaatcacttcatcaccttcgccaacacctaaaactcttaatgttgtttctgcacaggctgtttgagagctaaggcatactgctctgtttactccacacaaatctgctacctgtctttcaagttcctttgtttttggtcctgttgtaatccagcctgatcttaaggcttctgctacctgctctacctctgcttctgttatatctggtggtgaaaatggaattttcattcttttatccttctttctgcatttattataaatttcttttgttcatactttacttttgcttatctttccaactgccctgcttacacttccttcgccaccgcagcctgttccatcatcttgcgctgcagctcataaaccttgcctttattctcgcttccgttctttcctgccggatgataggtaggaacgatcagttctaccatctcgcggatattttggtcattatcgtaggcagctttcattaagacagtaagctgatgaagaaactgttcggtgttgaatgggattggacagccgatgtggattaatttatttttcgttttctttaatccctcttctgccattaatttttcttcaaagagtttttctcccggccgcagtcctgtatattcaatctttatatccacatccggctcatgcccggagagacggatcagattccttgctaagctgtcgatctttaccggtgatcccatgtcgaggacgaagatttctccgccttcggcgtttgttcctgcggaaagtacgaggcttacggcttccggaatggtcatgaagtaacggatgatgtccggatgagttacggttaccggaccgccttcttcaatctgacgtttgaagagtgggattacggaaccgttgcttccgagtacgtttccgaaacgtactgcgacgtattctgttcttggaataaatttcttctggcgaatctgatgcatgatgccattctcttcttcaccgtgtgtgtaaagcattggcatctcgtgtgcttttccttctttgatcattcggtcaaaagactggataatcatttcgcagatacgcttgctggctcccatgatgtttgttgggtttaccgctttgtctgtactgatcagtacgaatcgctggcagccgttgatcatggctgcgtaagctgttttatatgttccaacggcattattcttgattgcctcgttcggtgatgtttccattaatggtacatgcttatgtgctgctgcgtggtatacgatatctggtttatactgtgcaaatacctggcagattctccggctgtcacgtacagagcctgtaagcgcgatcatgtttaagtccggataagttctctttaaccactgttcaaggtcgtataagctgttttcgtagacgtcaaagagaatcagttgttctggatgatgtccggctacctgacgggagatttcggaaccgatgcttccgccggctcctgttacaagaacctttttcccctgaatatattggaatacttcgtctaagtttgccttgatcggctcacgtcctaagaggtcttctactgcgaccggcttcagcttgcttaaagatacctggccgtttgcaagctggtatacacccgggagactctttaactcgcaatttgtttcctgacagatatttaaaatgtctctcttttcttccggactggctgtcggaacggcaaataaaatctggtcaatgttataccgttctaccgcttctaagatagaatctcttcccccgacaatcggaataccgagcatatatcgtccccacttgtttttgttatcatcgataacgcagcaaggtctcgcatctacaagattggaactttttaattcttttaagataacctgtcctgccgctccggcaccgataatcatcgcccgatgaacactgtccgcttcctgtaaatgttccatcttcgtacgctctaacgtaatgtagcggtatgcaaatcgaacaagtaatgttaatgcaaactgcatgccgcatccaacgatatagtaagataatggcattctttctaagcagacggtaatgccaacaacctgaaatatcgttgtgattactgttgcagcaaaaatacgattcaattcgctgaagctggcaaagcgccataagctgttatacagcctaaatgcataaaacataataaggacaaatgctgtataaaacggtgcaaactttacaaatgcatccatatattctgccggaatatgggaatatcgcaaatcaaaacgcagccataatccgaaaaaataagacaggttcactgcaataatatcatataataccaaatacattgcgataactttccagtgtctgaaccggaaaccatgccttttcccttctgactcagtacattctctttctaagccattttttttaatcgtactcatcttttcttccctttctttcatacttttctcttttatttttaaaaatttatcatatgcttctttaagctgactatctggcaggatcatttaacatagtaaatgcctcagcacaggataatcctctgcatttttaaatacagatctaaatgtaaataaatgaactacggaacataaagtgatgagacaggtctgcttgaccgtcacagtaaattcgcgataaaaatcacgttttaatacattcttcaacgaatcgaagaaaaagattaccacgatattcatgagagcaagactccacatcatatcacggtataaagaattcgccaatacattcagcgacccatgccgcataccgaatgcaagcgtaaaagaaatccaaagacagactacgtccaggatcatgaaatccaggtgcttcaaccagccctgtacactcttcttatacatatactttccccaatcttatttttcttgtgctgattatcctataaatgaacttctatccccgcaaaatccatacttcttatatgataatcctgttttcatacttttttggtgtgtcttaacagacagtacacaaatgattcagagttgaactatagatgtaaattaaaatattctgatgtattgattcttcttatataaattttaataaaaccacacaccttttcatagtgaataaagtataccatatatttcttatttatagtattcttaaatatgaccaatttcgacctttaaatttgtctatttttggtcatgtcagactacattttcaattttccactaaaactttactttatctgtgttatttccttgtcattttttactgtttgtatatatataatgtatactttgtaaaattattagataaaaaaaagcaccacacatatgtgatgcccttaattcaagaagaatgtttcgtcattcttgctgtgagatgcgccggaggctatattagatggaggattgattgactcacaccacctgtaggcggcagaagtcatctcacatctgatatactattccaaatttctgcatttccttctgtgtctatagaaaatttgttttctataacatcagttataattcttattactccgtagtcttcctcttctttttccttattagattttcccgtacatagtaatagctgtgcattcttcttatactgttccataacatcttttactggtaaatcatttccctttctcatgacagtggaacaggcaatatcacatccatcccatcctaaatccaacattttaaccgagctgcctgatccatgatgcggtattttcataatatgtatatgttctccaaaaaaatttgcaggtatcttctctatagtatcgtcttctatatccccagtgaaaaaaattcttacacttcccagagataaaacaaaaaatattgatctgtcattttttatatatttatccgtataagtttgcttacgaacaagcttagaattaggtgcatatgaaactagctccaaagggaaattattcgtatcttttcgaaaagatatagaattataacacatcatgtctttcctatccgatgttgaatatacattatattccgtactgcaattaaccgtacattcctttaagtattgaaaaagttctctaacttctttgctacattttatttcacccatttcaacactttcaggaatccatatatgagttttttctgatgtataattatcaataatactttttaaaccctttgagtgatcccaatcaggatgtgtccaacaaataaaatccaatgcagttattttatttgcttctaaaacatctctaaccttatcaatatcctttaaacaaaagcaatcaatcagaccagaaaaactaattcctccatctgtctttataaaaaacagaattgactctccctgacttttgtaacctattatatacgtttcgataagcaattgtttctcaaaataaattatttgcttatatctggatatacttcttccagataaatgcatatcataactatacatgcttaaattccacttttttccctactatattagcggtattatccctaaacatatggattgtacctgcctgagactttgaaacaaattgtccttttacactttctttctttatattctcttgctgtgctacatatggatttctacttttcgatacaaacttcatcattttaaaccactcctctgattacatcatcctgaaaaacttcctgtttcaacgcttgaattaatttatcgcttaatgatttaataaatatctcaaattcgattgtgttttgtatttgtaaagtattttttataatttgttcatcagaaagcattggtaatatttctctattcccctctttgaacacatctacatctatgacgatctgatatgttgttttctgatttccatcttcttgttgaaccataccttcttgaatattcctaacataatttgcctggtaattatccttagataaaattgttaccatgttcgaggctatataatcgtattctgaaaattgttcaatcacatcattcgcattaaatgctgcttttgtaaaatataatggcaaatctgctaaattatctaaaaaacaaatatttatttttcgtaatccaattcttaatggttggaaatatggggatacagacttaataactgccatgctttcggcaagtaaaacgatatatttgtcaaatgtttcataagtctggtcaatatcgactgtaagggtaaaaaagctcttgcttatctccagtatttctttattatctgaggaaaaaatatatactaaattcttattattattacttacagaaaattgatttccttcaggaatgtttaaatccatctttacctgtaaatcaaattgattttccgttcgtttccccatgtttataaaacctgcatcaaaaaatttctgtctcaaagacaaaatacatccttcaacatctgcttccataacaccttcataatctaaacggaaaataatctgtttcaaaaaattatgtttaattgcagaacgtaaatcattcattgttacagcctccttatttcggtaaatgtactctcggaatcttttcacaaaagcaagtgcaagaaagactccgagagtacatggtaatttattatatcatttattccttttaacgtccacatatacattgtatttttctggaaaatccttactctctgggataaaaaaagacatatctgacagctgctaaactgctttgatatgtctcctttattttataaggttctatctctcattttacttacttaatggggttcattacttcccgttatactgatagcgaactccttttacaacgtatcctgctgctgtcttcttcaacttcagtgttgttgtgccgatgttcgttctgcccttctctccgtagcatcctaaacggttctgtgttgttacggtgtagatattcttaccagtgcgtacaacctttttaatcttataatctggaatcgtatctccgaagtctccgccacagtacatgtatggatctttataaaacttactgtcggagctacatacgaacattgcctgattcttatttttcttgctgctcttaatcttgctgacagaagcgctcttaccaaaaagcttcttagtctcggaacgaagctccttcgctgtatagctgtagtcacctttgtaattatatcttacgaatacggcaatggataacttctgattatcgttaagtttcatctttactggcttggtagtggaccatacgcttatgttcatcgctgtcgtatatgctgtcatcttcttactgatatcctttatctgacgattccctgccatctgtctggtcacatctgctgatgctgcctttgcatgtactggagcaaatggaataagtgttactgtcatgagtaatgtggctaaaattgtacttaatcttttcttcatagggaatccctcctgccttttgaacttagaatgtggtgtagataatacgctatttaaatgcttttttaatgtgctttaaatgctatcttctgtactacatttcttataattttattataatatttttgctgtggaagtaccataacagaagtgttatttttctttacaggtgggataagaatgtataacaaaagtgttacaaaaataggaatttgccgcaggcaaaggagacgccctcttttgataaataaagtcacagatataggggatattctctctgggggttcgtctgtttactcaccccggcaaattccaatttttaatagtagaattcccataaggatgttataatacaaatgatatcttttaagaagggacggtgatataatgggtatctttttaaacagtactgcaccatttgaagcatataagataacagccctggataaatactttgtagataaaacgatgttaatagaagaattgattccatcaataggaagagaacaaagatttttgtgtatcacaagaccccgtcgattcggaaagaccgtaatggcaaatatggtagcgtcatattttggcaaggcaatagatagtagttttgtatttgaacatcttgcgatagcaaaaagcccggtatatgaagaatatataaataaatatgatgttatctatattgatttcagcaggcttccagagaattgccaaacttatgaagaatatattaatagaatcaaaacaggaataaaagaagatttgcttgaagaatttcccgaattagaattgaaagaagaaatgtcactttgggatatcctggcaaaaatttttcaaaaaacaaatcgtaaatttatgtttataatggatgaatgggatgcagtatttcatatgccatttatttcccaaaaagaaagacaagaatacctgctttttcttaaaaacttactgaaagatcaggtatatgtagaacttgcttatatgaccggaatacttccaatagccaaatactctgccgcttcagagttaaatatgtttgtggaatataacatggcaacaagagaacggtttagctcttattttggattttcagaagaggaggtagataaactgtttcaaatttatagtgaaaccacaattcgaccacgaattacaagacatgatttaaaaatctggtatgatggatattgtacggcatcgggtgaacagctttataatccccgttcaattatctgtgctttatcagataaccagctaggcagttactggacaggttctggtccctatgatgaaatattttattatatcaaagggaatattgatgaagtcagagaagactttattcttatgatttccggcgaacatatagaggcgaaagtacaagagtatgcggccaccgcagaagaattaacaacaaaaaaccagatatactctgcaatggtcatatacgggttacttacttatgaagatggagaagtctttattccaaacagagaactgatgtacaaatataacgaactccttttaacaaatgaaagtttgggatatgtatatcggttagcaaaagaatctgaaagaatgctaaaggcaacactagctggagatacacaaacaatggcagaaattttggagtatgctcataatacagaatctcctattctatcttataacaatgaaatagaattatctgccatagttaatcttgtatatctggcagcaagagacaaataccgtgttgagagagaagataaagcgggaaaaggatatgtagattttatcttttatccggagaaaaagaacatttctgcaattatactagaattaaaagtagatgcatccccagaagaagcaatccagcaaatcaaagataaacagtatattttacgttttaaaggaaaattagcagaaaaagcaaagtatacaggagaaatactacttgtaggcataaactataataaagaaacaaaaatgcatagctgcaagatagaaaagataaataggaatttgccgcaggcaaaggagacgccctctggaagataaattggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgaggctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatattttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgagcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccagataaagcatatttgtgactttagtcgctgcaggttgaatgctcgctttaagcgctcgcatccaacctttgctccgaggccacaaatatgctttatttatcttccagagggctgtgttttggctggggaggaaaattctatttattgctggagggatttggggaatcatcagatggttatggctttccatgaaatagtagttccatctccaaccaaagtacagccccctcctctgctttcgcaaaggagggggctgtccgttttgcctctctctactggttcttggttttttaaggcatatctttatctcttgtatactaccacagggaactcccgttaaagtagctgggttagaagattactcttctgtcagcttaaatccggcaattctagcaagctcgcggatagaatctctggataccttcttacctctgtattcaatgaggtcttcacactgtcctgtaaagatatcactagggttatacttcttaatgatgatcttatcttcttctgtgaagatttctaaaggctctctctcaccaatatcgaaacttttacgaagttccataggtaatgtaattcttcctaatgaatcaagctttctaactattcctgtactctgcataacgtactcctctctggtgctataatattctctcttatgatgtgcacccgtgcaatgtcctctgggttgattgtagtatatcataaagcagctagtctgtcaaccaaaaaatagataatcttttttaaaatgttaaatgttttagaaactgttgttttgaaattgttatgacagtttgccgttttattttcattctagtataaatatgggaagttttgtgctttcttctataaaaaattgttatttgattcgggttgtctcattatctcccgtgtaaaatagcaactttttactttaatttgagtaagtactgtccatagttggtcatcttgaggctctcgccaatctcatgaaccttatctaaagatacgaatccttctttccatgcaagttcttctaagcagcctacatagcatcctgacttctgaagtgccttaacaatctcggctgcctctaacatactgtctgctgttccggcatccatccatgtaagtcctctgtcaaatggaattacctttaactggcctctgcttaaatactctaagttaacatctgtaatctcgtactcacctcttgcggatggttcaagattcttagcaatgtcaattacctgattatcatagaagtataatcctggtatgatgtaattagactttggattctttggcttctcttcgatggatacagcctgtccgttctcatcaaattctacaacaccaaatggtcttgggtcatctacataataaccaaatacctttgcgccgtggtcatccttgatggcttctttcatgatctcatcaagattatggcactggaaaatgttatctcctaatacgagacatacagaatcatctccaatgaagtcttctccgatgataagtgcatctgcgattccccgcgcaactttctgtactgcaaactcgatatgaagtcctaattcacttccatctccgagaaggttctggaactctctttcttcccctggtggaataattacaagaatgtccctgattcctgcctgaagtaaagtggcaattggataataaattaacggtttgtcatatactggtaataacggtttacaaactggctttgtcatagggtacagtctcgtacctcttccagccgctaatactattcctttcataaaaataagtcctccttagtaactttgaatccctatgttactcataatgtctcaactatgctgtcaacattcttacatgatgctgtctttagattcatgcttattaatgcttttattttaacaaactaccatgattccaatattttatattattttccatgagctgtcaaactttttttgcaatttagttaaatatttatatagtttgtctttattttcctgcaaatgcgctctgtactgcagccatcgacagtatttaggaacgtttcgcggaatttcttaaggtctgcctgttcatttgccgatacaatattctgaagcatggcagcagattcctcgcataatgcctcaaaatccgtgacaacgggacctggtgtaaactgcgaataatcaaagtaaaagtctctgctgtccatgtattctttctcatcaaatgcgtagaaaagcattggtaattcaaggattgctgcctcaaatacgctggaactgtagtctgtgataagaaggttgctgatcagcatgaggtcattgatatgttcttccccgctcaaatcaagtactctgtcctgccattgtgcatccacagtaaacttttgctttacaaatggatgattctttaaaataagtaccgtgtcttctggctgcctttccataaagtgattcacatcaaatgcttccaatggataatatgcatctttattcccatctccgcggaatgtcggtgcaaacaagattaccctgttctcctttaatataggatatttcccgtagagttcctcgcgctttttctcctcataatcccagtcaaaaagcaaatctgtacgcggtactcccagcgcctgtaccttacttcctgaaatgccaaatgcttctgcataaatatctctcaccgtatcgctgctgactggtacgaggtcataattcctgtgattcatcgatgtctgaggcgcaccgccctgtttacccatacgggtaaggccaaacgtcttaaaagctccgcaggcatgccacaactgcacaatctttgtctcgctgcgtttctgaatgctatgaagctgcggatagaaatcttctaaaatgataactgcagatgtagcgcatttgaacgcacaatcccgaagttccttcttgcgaagctgatcaactgtctttgtattgataaatgtcgtaatctctacctcgggttcattctcctcaaaccacctcttcacaagcataagattcccattcttctctggctctctctctgaaaggaaaagaatctgattcggatttaccttattcttcgctatatatttgcggtatctggctgcaaaatagtcagtattttgctgacgggcactataattataaccactaattctatatacggtatcattcgcccgcttcgctgcctttataaaattcttgtcttccttaaaataatctctgaccagtaaaaatggcaatccaagagagcaaagtccaaacttgaacagattcctcttgcggacaatctccgctctggcaaatagttccttttgcactggaaatggctggtcatctaagcaaatctcttccgttccacaccaaagcgtaaaaataacattcaccttatggcgtggcggactgtaaaatacatatggcagcaatatctctgcatctgcgcgaatctggtcaccaacttctccttcttctattactacttccatcggaaaacgacgttctacctgtctctgggtaaatacagcctgcacgcggatgcgctttccctgcatctcgtccggcatctttgcgcgaaatccaagcttcatcgtcttctgtgttatattaactgtaattctgtaattaatctttctcataattctttgtccattattttaaattatcacaacttatttgttcattagcttagagtgtgtttgaaaaatcattcctacaacctgcacgcctcaatttacagattatttttccaaagttccctgcatatagttgtccatccagcttaaatcaatctttttctcccactgccttcttgcgatatcctgcttcagtgtgagcgccagatcctgtgacttcttcgcagactgaccctggctcactgtatctgcagcacttcctgcaagtgctgtacttccactctggctacctgctttcttattactcgcatctgtgttcaccacaataacctggctattctggctcactggcgaaagtacagatcttcccgcattagaagtgcctgccaatgcagttcccttacctgctccgattgtatctaaaaggctcttaccagttgacatcttaagaatagatactacctttttcatagaaacatctgccttctcttcctggagtacttctggaagatttccctttactttcatgtaggaaacatcggcaaaatcttctgccatatcttcttctgtataatccttaatcgcttgtttctcccgaagcgcagacttactctccttatcataggacatgatccagaatggaccgcctgcactggcaccttttgactgtgcgattacatctgacagtctgtacttgtaagcggaacgcgccctgcttccgacatcggctactgttacgcaatcgttcttatcaattgctaccagtaccataaaatgcccgcctcgggtaaaatatccaggtcccataaggcacactactggcttgccttcttttaatgcctttttaatcgcactataatcggttcctgctccctgacacttcagtccataagccgctgccatcgcaggaatcatctcatgtgcagaacctgctcttgagtaaaagccatgctgatagccccagatggctgtatccaatggagttacccacttacctgtaagagatgtgattactactgccatggaagtcggaccacatccagccttagcgatacagtagccattctgattccaggcactatctgtctgattaaaatatacatatcccgcaatgtattccttattattcttcatagccagacgagtatcattataaatcttcgggataaatgtactcgttttatcgcttccgtccggtgcgtcttcctctgctaactgatccgtaatcttcttaatcgcctttgtacgaatctctgcatcttctcttgaggaaatgtccttcttcgccttcttctgagttgttccttcttcgttactatgagaggaatttccggatgtatctgatgtagaagaatcggtatcttctgcctgatctgtattaccagatgtaccagacgtattcctcttcgtaccttctgttgtatgttctgtctgcgaatgctctgtattaccgctgcttgtatccctttcggaagaagtctggctctcctgactttccgttgctgtcgtactctcttctttcttctctgttgtcacttctgtcgtgctctcgccttcttcagaattatctcctgctgtcttgctctgcacagccttctcctctgctgcataaacacttacaggttctacccctgactgaaaaaagcattccggacctgtaaatgtcatgactgcacttaaccccactgccagtactgcccgtccaaagttgttcattaatcctaaaccttctttctttttgatgtagattttttcgtgacttactgatataataaatcaaataacatatttttacaatagtcttttgcatagttttgcatatttaagaattacttcttcacgatagtaattccagtcgcattctacttatattttatttgtatttacttgatacaaagattttatagatattgggacaatattacatttcaacttgaaatgtaattggatagctgaatattgaccacatattattaaagattattttccattttattctgtttgaaggaggagcatttataatggataaaaagtttaattttcaggaattacaggcgattgttgccacacttcgcggagagaatggctgtccgtgggataagtcacagacgcatgaatctcttaagttatatacattagaggaagcctacgaggtgaatcaggcagtaactgacctcactaagactggcgactgcgctaatttaaaagaagaacttggtgaccttttatttcaggtacttttgcaatcccaggttgctgaagataatggcgaatttgctatcgaagatgttatcgatggcatcgcccgcaagatgatccaccgtcaccctcatgtatttgctggccgccattatgatagtgtagaacagcagcaggccgactgggagaagttaaaatctcaggaagaaggacataaacagacctctttaaaagaagagattgcccttgttccagaaagtttccctgccctcatccgcggccagaagattgcgaaaaaggctgccgccgccggactgttttccacggaggatgaagatgtctttaaagacctgctaacttctgttgtgaatttacagctcggcactgctggggaagatccagagaaaaaattcagcagtgatgaggaattgtcagagaagctggggaagttctctttgcattatgtcggttctgtgcgaagtataaggtttcaggggaaatggcattgctgaagaagctggaggaattctgattgccgcaggcagggggaaacgctcctaacgggagaagataccctttttgaatggctccaaagtcattttcgctcatacgaagaataatgcctgccccgagaagataccctttttgagtggctccaaagccagaaaaaagcagcttaattcattagcattagaaggtgtttaaatgctaatgaattaagctgcttctcctgtcagagacactcaaaaaatctcatctactaaaatcgtgcaaaactggctgtaataatagagaaacttatacatatccttttctcccattcgctcttttaccctctctaagagcttacagcatttttcaaattcctcggtgataagttcttttccagtctgggtgaactgtaccttgacgtagcggtgatcttcttcgctacttttcatttccagatatcctttacgctctaaattatggagcattcgggatacggctggccttgacagcttcatcgcatccccaatatctgacggaatgacaaattcctttgccagtaacaggtggcgcagggtgagtaacattgtcagttctcctgatggaatgttacacatttgctgaaactgtacattggcctttcgcatttggatgattagttgctggtagtcctctaaagtcactttttgttctgctgacggctcgccttctggccagtcagaactccctgtgtctttcgctttcatatttttgttattttcctcccccaaaatagctttattttaaaattctctttactattccacgataattctatccttcattggaacatattccttatccatagccacactctggtatgctggacggataatcttatcgcagttcattaactcttctaaacggtgtgcgctccagccgaccatacgtgccacggcaaacatcggggtgaataactggtctggcagccctaagatccgatacatgaatccgctgtaaaagtcgatattggcacttacacctttatagatacggcgtttttcctgaatggtttcgacggcgagtttttctactctgtcatagaattcaaattcttcatcgtaacctttttccctcgcgagtttgtcaaggaatcccttgaagattcttgctcttggatcggagatagaataaacggcatgtcccattccataaatcaatccgctgtgatcaaaggcttccttattgagaagcttcagcaagtaatttttaatctcgtcttcgtctttccaatccttcacttcctgcttcatctcatcaaacatatgaacaactttgatatttgctccaccgtgttttggccctttgagtgagccaagagatgctgccatagcggagtaagtatctgttccagaggaagttactacatgattggtaaatgtcgagttgttaccaccgccgtgatccatgtgaagtacgagggcaatatctaaaactcttgcttcaagtggtgtatactttttatttgggcggagcatacgcaaaatattctccgccgtggaaagttcctgcttcggagaatgaatgtaaaaactcttgccttctacataatgattatatgcctgataaccataaactgcgagtaacggcacagtacttgtaagctgtaagcactggcgcagtacgttcggtatggaaatgtcatctgccatatcgtcataaccgtataatgtcagtacgcctcgctgcagtgtattcatcatgtccttacctggtgctttcataataacgtctcgcacaaagttcgtcggcaatgtacgataacttccaagaagattctggaattcctgtaattcctgcttctgtggcaaacgtccaaaaataagcagataggccacttcttcatagccaaatctctgctctgctacaaatccgtctactaaatcgtgaatgtcgtagccgcgatagcgcagctctccatcgcagggaaccatctttccatcaacttctttggaagaggtgatggtggaaatatccgtaagtcctgccagcacgcctttaccgttcacatcacggagacctcgcagtacatggtactggtcatacaggcctgaaggaatctgtccgtgttccatagaaagtgcagccagatcctgcagttcctgtgtcatcattgagtattcattcattctatcacctattctttcctggttaacaatgttagttagctttgttaattattatatagaaaaaaatttgttttgtcaaattcatcacagatgaagtatactagagcgtgtttgaaaaatactttccccataaattgggacatacatattactggagtgatttctcaaacactctttatttaactacaatttattctgacaagattttaccctgtttataagtagtttacgcaaaaaccgtgtctcttaccaccaaaattttatgtaatgtgtacaagttttttctgttttaaaatatttgactgtgctatactataaataactgtatatacgctgaagaatatatgcactaaaacgtatatatattacatattataatcggggatagtatgcacttttcccgattttaatgcaacttataattatttaaataaaaatattttttagaaaggagcgtatcatttatgcaaatacaacgtctcgtagatctggaggactacgaatttgatacattgctcgtcacatacaatcataaaaatcgtctgagtatcgagcttggaaaagttagcgagatttttgaaagtcttcaggccgatggtctcgttggaggaagcaaggtatacggtctccgaggaaaggatttttcttatcagggacagccttattataacctgattttcattggtattcctgagaaggcaactccgagaagatttcagttacagttcggtcaggctatgaaggaagcaaagcgtttccacggaaagaaccttcttatgaccgcaatcggagaagatgtttcctactggttaagttctgctatgaagggacttctcctcgcagattactcttttgacaaatacatttctgataagccagaatctccagagctgcatcttggaattctgacaggaattgattctgcatcctttaaaaaggaagagcagtacacaagaatgatggcaaaagccgttacaacagcccgtgacctggtaaatgaaccagcgaacgtgatgactcctgcagctctcgcagctaaggcaaaggaaatctgtgaaaagaacaatatcaaatgcacaattcttgaaaagcaggattgcgaagcactcggcatgaattcctacctggcagttgcccgtggttctaaacagtccgctaagtttatcgttatggaatataacggccgtgttacagacgatgaaaagattgctttaattggaaaaggtctttgctttgactccggcggatataatttaaagcctggcaatgccatgaaaggcatgcatggtgacatgggcggcgcagccgcagttatcgctgctatgggtgcaatcgcagaggcgaaacttggcattaacgtaaccgcagttattcctgcctgtgaaaatatgatttccggcaaggcaatgaaaccgggcgatatcgttaagtctatgaatggcaaatacatcgaagttgttaacactgatgctgaaggccgtatggcacttgttgatgccattacttacgcaatccgtgaatgtggagctacaacattaattgacgtagcaactttaactggagcctgtgttgttgccctcggtgaccgctacactggtgctttcagtaacagcgacgaacttatgtccaagattgtccaggcatccatccttgcaggagaaaatatctggagactcccaatgggcgatgaagaatatgataatctgaacgcatctactgtagcagatatcgctaactgtggtaaaaaatgtggtgcaactgccgctgcaagattcttaggtgaattcgttgagaaaaaaccttgggtacatcttgatattgctggaacatcggaatctgatgaagatactgagatttactctaagggtggaactggtgcagcaacaatgttgctgtatgaagtagtgaaattgatggaaaaaccatataagagttattaaatcctgatttgcacagcaaagcagacgcttccaaagagagccgataccctatatttgtgactttagtcgctgcaggttgaatgttcgcttaaccgcttgcatccaacctttgctccgaggccacaaatatagggtatcggctctctttggaagatttcctggctttatccattcgccttataactcttttgctttctttagcatttttatcgcaaattggggcgtgcagattgtaggaacgttttttcaaacacgctctagttaatagaaaaaagtagtgactataaataactatacgattatggcactgcttcaagtgtcaatcctataaaattttatttcccggaacttctacatctcctgtcctcttccccaaatccctccaactgattttctgagctgccaacgagcagaactcctgaagataaataaagcatatttgtggcctcggagcaaggtttggatacgagcgtgtataagcgaatattcaaaccgccgcgactaaagtcacaaatatgctttatttatcttcaggagttcgtctgctccgcagcctcacaaatcaggatttttaatcaaataactgagcttctctgattactacatttttatttttattccagatagagttaaattctcttccacttaacggtgctgctcccactccaacttcaatggtaatgcatggaatatttcttttatagaggaagtattctcgagagcatcctcttgctacagaaatggattcagttggcataagatgatatcttgtaagactttttgctaatttgtacattcttgttgttatatttcttacttttttagttgcgcggctggcacatcttccataaagaatagaacctgtagaatgatagctgacaacgcctgcgattttccctcttctctcaatacgatttacccattttacaagtgcctgtacttctttttcactggctgctttgggacctcgataaccggaggaaccttttttaccggcctttttaaatgctaccttccagttacgatttaaatctacacctcttgcattggctttccatttactggaacttccgcccatccttcttaaaccatttctaagacttttattacgaatagcgttaaatcccttctgactaatggctgttccatctggattacaggagggtacatagtgaattgctaccttatttaaagtagctgaaacttttttgccatttattttcttattataattattcagataatattcaatttgtttcatgcataactgcactgtcatatgttctcttgcatgaagattcccaatcacaagaagatgcttctttgcgtttggatttccaatcacaacttcatataaattccttttatccgcagttttaccgattacatttacctgacaatgatctctatattttttctgcaattgttttaaatcagtttttagttctttataactataatttttctttcctccagaaacaatagcggcattaacggtcaatccctgtgttgtaaatgcgatacagcacaccattaacatggcaaatactccgcttaagattctttttatgttgctttttttcatctttctctcctattttcctctgcaatagttcttattttttcttagtatatgccttaacaaaattgtatacaagacatgctgcaacaatgactgccgccattgtaaaaaaatctccaattgtcatactagcacctcctttataaaatatcttatatttaaatatttttatatttccgcaatagcgatatcatgtaaaaagtatatcatatttaccaagaaaataatagaatcaggcaaaaagagcacaaaaaaagagagcatcctgactactaattctagatgctctccgctaatgattttcaattatgtccaacggactatacctcctatttcccttttaactctaagctaatcttccgtggtctgtattattcgttatcagttttccttctatcttctacaaaaggattatgatttataatacacctgcttccaatcccttaaaatctccggttatattattcatctcttttttgggcgattattcttctgaattctaagctgattccctggattctctaagttcttctctttttactactacctgaagtgttatctcttgatattaatcactcgcaaccatcaaactttcaaatctgcaatctcacttaaattcgatagcttatgtttttgtcggtctgtacctcctgctatgatatcgtttcgagtcttagcttaagtttttgttggaccgtacctcctatattagtatcgtttcctaaatcctaacttaactttctggtggtctgtacctcctgtttagtatcgtttcctgaatcttaacttaactgtttggtggtctgtacctcctatattagtatagtttcttaaatcttaaacttaactttctggtggtttatacctcctgtttagtatcgtttcctgaatcttaaacttaactttctggtggtttatacctcctatttagtatcgtttcctgaatcctaaacttaactttctggtggtctgtacctcctattattaatatgttactaatctgaattataacttatgtttttggtggtccgtacctccttctggcttatttaaattctgaaattaattttaatctgtttgcactctcacctctttttcatgataaaagcaaaacctgtaatttcaaaatctatatgatggactgtgccgtccgttctttgtttatgtctgtattataaagcaggattcttattttgtcaacactatttttatatttttctctgattttctaaattcaatattttatcatctgtttttttagtttttactgaattcattttattattgtcagaatattcaatctttttaaaaatcacaactatctgacggggtgtacagattgtaggaatgatttttcaaacacgctctaaaactattatcatatgccattacgataatggtttaaatgtcaatccaacaaattttcttttccagacattctgtattctcctgtactctccccaaaatccctccaactggtttctcgagcttccaacgagcagaactcaggcttttatatgaaattttttctgcatttcttttctcccccacaattctacttcatttcttttggcgagatctctggcacttttcgtaaagttgctatttgtaacaaccattgcccgatcagctttgtaataagcaatagaaccaacaacttcctgaacagccgcaattcccacatttcgctcatagcgttttgcctgaacaacaatcttttttccccatttgcgaagaacaagatctgctccatagtcatggctataacttgtgagtgtaacatgataaccgagatgccggaactggacagtgagataacgttcaaatgctctaccatttaatttgtcaatatttttcattttcatatggagatagtaaagcgtgtgtaatcgtctaataaactggaaaatgcaaaaagcacacagaaaagaacagccaactgctatttctccctgtctctgcatataaaatgtatatccctgcaaaaatgtgtatataattccggctacccaaagccattttataatgtcaaaatgtctcatttatcttttgcctttctgaaattcaagaatgcctcggcattcttgctgcgaggtgcgcgtcatgcaattgcatgacatacttctactgcgcacctctgcaatcctgccggaggctatatcagctgggggattgactcccaccactgataccagcttgtttctcaccacctataggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaatcctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcccgttatcataaaactactcagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacactattttagcaatattttattatcaaggaacattttggcatatatttgacgccctgtgatactaaacttaccactttttcagtggcgtccctatagaggtgggagtcatctcccaactgatatatctttaaattatacactatacatgtaaaaaatgctaattttcatatttacatttcaagaaaattatggtaatatattccttgtaaataaccattaggtatatagtttagaaaggatggtgtcaaattggcaattaaaaataacgtaaaaccagacactgtactaaagactttctggaagaataatcagcggtttgcagatttagcatatgatagcagattctcttatttacttaaaggaatacaacgagataacagctaaaaacagaaatgaaaaaaattttgatacatccgatgaatttttatccggcctacaaaaaagtgaccgtttacatccagtaataagcttgtgcatatactatggaaaagaagacatgagaatgagtctgcctgggaaactaaatttcgaaggattgacacaaaaatccataagaaaaaattattatttttacacattaaaataacaatatgagtgtcgaactcttatgactcaactttttaaaaagccacaatcttctggcgattccccaaatcactccaacatgaaatagtaattccatctccagcaaaaacacagcacccaaagagagcaggtagcctatatttgtggccttagaacgaggattgaatgcgagcccggggcgaacattcaacccgcagtgatagagtcacaaatataggctacctgctctctttgggtgcgtcttcttgcctgcggtaattattatttcactggcaaattcctatttttcttcgttatctaatgctgcaattcccgtttcattggttcggattctcacaacattttctacatcgtaaaggaaaatcttaccatcgccgtactcgccagtataaagtgctttctttgcggcttctacgactaattccggtggtactgtagatacgacaatgtctacctgaagctgtggcagaaggttcatatcaatcttaacaccacgatactgtccagtttttcctttctgtgttccacaacccattacatgggatactgtcatacctgttacaccaatctggctcatggcatctttcagaatggcaaaacggtcttctttacacataattgtaagttttgtataacgtccacctgtttcttttgcaccgccgatgactggagcgagtttcttgtctcttaagtctgttacatcgattgtttctgttgttacaccgcccattgttgttgcggaaattggaaggaaatctgcatatgctgatgcaagatcatgttctgcgatatcaagacccatgatttcttcttctgcactgacacgaagtcctattgtatgtttaagaattgtaaatacgattgtcattgcaactgctgtgtatgctgcgatacatacaacacccagtacctgtactccaagctggtggaatccgccaccataaaatacaccattgttataatcgaaaagtccgactgctactgtaccccaaagaccattacatccatgaacggctacggcacctaccgggtcatcaatttttagtttctggtcaataaattctacgactattactacaagtataccatcaacaagtccgataatcgttgcaccaacggcatctacattcgcacatccggctgtgatacctacaagacctgctaaagaagcattcagacacatggaaacatcaggtgctccgtttctgatccatgtaaacatcatacagacaaaagttgctactgccggtgcgatagttgttgttccaagaatctgtgctaactgtgtaggatcagatgctgctgcaccgttgaatccataccatgcaaaccataagataaagcatccaagtgcgccaagtgtaagagaatgtcccggaaatgcatttacaacagtttttccgtcttttccttttgtatatttaccaatacgaggtccaagcattgcggcaccgataacagaagcaataccaccgaccatatgaattacagaagaacctgcaaaatcaacatagcctaattttgcgagccatcctgcactattccatacccatccagcttcaatcgggtatacgattgcactgataactgcggaataaatacaatatgtagagaactttgttctttctgccattgctccggaaacgattgttgctgctgttgcacaaaatactaactggaagaagaaattggaccagtcaaagtttgcgaagtctgtgaacatctgatattccggtcttccgatcagtccaaagaaataattttcactgttcataataccgtaaccaagaacgaagaatacgactgttccaatacagaagtccatcagattcttcataatgatatttccggcatttttcgctctggtgaaacctgtttccaccattgcaaaaccacactgcataaaaaatactaatactgcacctaaaaggtaccaaacactcatatccatacttttcactcctaactttttttgcaggtctttcctgctttttcaagaaaatgctttctcactcgcgaagtgtttttattttataaatttttataaaataaaaaatggacgccaaaacaattatgtttcagcgcccttgcttttcatgcatttatttttgcatttttgggcttgtaagtcaatgtcagttttgacttaacttttttagttctttgggtgaaattttattatattgtgacagtgaaattttacgataacaaatagtgcttaattattttaagtcttatggcatttttacttatttttttaaaaagctcatgaaactgaggaaaatcaacattttttattgtcaataaagaaagttatgatattattatttgttgaagcacttatggtatagctatattttcctgtatcagaatttacataatcaacatcaaaagacatatcaggacttggatattccttcaatttttctaattcatcaatactatgaaaacatggacgcattacatggccatcttcatcccatgtactacaactacactctccaaacttatgttttccattttcaaacattttcaatattgaaataatgttgcttcgcaatatattgtcatctaactcatatattacactatttgataactctctttttgatataatatttatcatacaacttctcactttctccatcccgctggatatttgtttttcagattattgtttacgagttttccaaatcccagtggatgtcctgctgccataactagctgccagccttttcgctttttttctccgttgatcaaatcgcttacgtcaagggtttcgccgcgaagatatcgctgtaatcgttcatcatctgctggaaagtcaagtacctgatcaaaatcctgtgcacggagtgcgagtgcaaatggctgagacggttcaaatcttttctttttgaattcgcccatgaaaaggccatttctcaggaaatgtaatcctcgtccatcatattgtggttctggaagatagtaaagattatcgcctcgcacgtcaattctgcccacatcataagcaaggtttacatgggcgaagaagtcttctgcggctgctttttgctctttgcttaaacttttacatttttcccaccaaacggaactcagtgtttctgtttgctgtttctttttagctttttttgattttttagaagctttttcatctgatttctgacttatttcaatattttttctatcaaatacaggctcggcatcttgctgatactttattgtattctcttttttatctctgtttaatatttcgcttgtatttgcttcttgattcatatggaatgtcctgttcagacctgattctttactattttctgcctgaagatagtttatattctgcataacagaatcctgctcatccgattttatttcctgttctgccccgctctttttatgaagaagtgccataaaatgcccttcaccagacattttatgcggccagattctacgacagagtttacagctttcgtcaaaagcttcgtctttataggatgtgagtccttccgcaaaattttcgtaatcttccattggaacgacttccatatccgggcgttcctttaaaagatgagtgattgtcttttcattttccaaaggggaaaatgtacaggtggagtaaaacatcatgccacctggaagtaacatgtccgctgcctgcacgataatttcccgctgtaattttgaaaaatattccggacctttttctttccaggaatctacaacggctggattttttctaaacattccttcaccagaacatggggcatccaccataatcttatggaaaaattctggaaaacgctctgcaaggacatgaggtggctcattcgtcacaaaactattggaaataccaaataattcaaggttacgaagtaacgcttttgctcttgctgtattgatatcatttgccactaaaaggccctctccttgtaaggctgctccaagttctgttgccttaccgccaggtgcagcacaaagatcaagaactctctctcctggctgcactttcagtctggatgccggagtcatggcacttggctcctgtaaataataaagccctgcactataaaaaggatgctttgctggaacatcctctgcgttgtaaaaatatccatttgaaatccacggaactttttttaaatgaaaaggagcaattctttcgaattcctccaagttcatctttaaagtattcacccgcagaccatattgtctctgcccgtcaaaaccggtaagaaacgcttcataatcttctcctaaaatctctttcatggagtcaaggaaagactgtggtaaatctgccattgaaatatctccttattgtttgttatttattcttagagcgtgtttgaaaaatgctctagtgaaatgttcgtcccgcttgctgtgtattatgtacattctgctctgccagagaactttttgctaacacatcttttttctgttttaataactcttttataatttcttttctggtgataataccgataaacacgttacgtccatctacaactggcacaaagttctgattaaggatatgattatctaactgttcaatatccgcatcaatacttactggtttgtaatcccagcgaagacgcatggacttcacatgagacttacgcattacttccatatccatatgatactcttcaatgagattccagaggaaatccccctcggaaattgttccgacatagcgccccttctcatcaatgaccggtaccgcctgataaccatgtttatgaatgacacgcaatgcctgtgctacggtgtcttcctgatgtatgtatgttacttcacttttaggaatcaaataaaatgatatattcataataattctccttctcacccttgcttcaatccccagagaaaatgtatactctctaagttcaagaatgcctcggcattcttgctgcgagatgcgcgtcatgcaatgcatgacatactccccaatcaatgcttccctttaatacatacacatcataacataagaaaagagatttcggtagccttttgcgaaagcttcataaaatcttcataattgtgtaatttctgggttggcacaggcaagagtagactcacccaaagcgagaagattttttgtcagttgtgcccaaatttttgaggcgtacgtgagtgcgtacgttgatgaaattcgggtgcgactggcggaaaatcagccacaaaagcaagtgcaagaaagactccgagcgtacatttttacttcagtatgcaaagaacagaattcatccttgcctgcggcgaaccaaaattagaaatgtttctcaatatatggagccattactttttcgaattcctcatctctaggccaccactgatcatgtgttgtctcttcgattggctgtccctgaatatcataaacagttattttcccctctgggttgcccgtaaatgcagcaagttcttcaaattttacctttacgacattacctgcatcagcaaagtctttttctgcatggtctgtaacatacaggtaactctgtacaaatgtattatcaaagtatttatcttttttaatctgctgatggatatgtccgatatatgtgagctgctctttttccaggaaaagtcctaactgttctttaatctggtgaaccatagcttcttcgtgtgtttcttccgggtcaatgtggccggatgtaaggatgtcgtatgctcctttgtaaactatatcgtcctctgctctcttctgtaaatagaaccagagctgatcatcctttttctctgctaaccagaaatggactacctgatgtaagagtccctgtgtatgtacttcttcgtatggtgcaacaccgattacgttatataagctgtcataaatcttgtaatttttttcttccataatgtcctccctgcatgtatgcgtttatgctagagcgtgtttgaaaaatcatttttcaaacatgctctagtgtaccgccaatcggtacgctaggtattttccttcccctattgtatctcatttttaggaaaataccagagtttttttactatttaattcattaagcaaactacagacgaagccattacccccaataaggcatatttgtgattttagtcgcggcgcgttgaatgttcgctccacgcgctcgcatccaacacttgctccaagaccacaaatatgccttattgggggcaatggcttctgtgctgtggctggagaagatgaattaaacaggaggaggagatttggggacagaagctgatgtcttctgcttacttgagaatgactgggaatagaggggatgagttggctttttatcttattgttgttattttgctatattccgtatagaacgtgtttaaaaaatgctttctgcaaagttactgttactgcaaaaaagatgatttctaaaaaaagctccatttataattcgctcacatacttgcatatatacaggatgcaaaagcatagtacccatcaatgggaggcagaaatgttgcaaaaaatttaagaattaaatatttgattttttaaaaaatatcgcatataataatgatgagaacaacacattgttcttcttcatctgatgagtcctgtgacggttccgacaggacgctaatataaaaattgaccgaacgatgaagattttcaaacgagaggctatttttaagtctctcgttttatattataggagacattatttatgagtaacgacgtgcttgggttgttgaaaattcactataaaaaataaataatatattatacgaggagttatattatgaaagaaactattttactttataatttagattctgctgctattcgaaataaaatcaagtttttatgtatacaaggtggtattcatattcgagttgtggaaaagaatcagtatgatgtacctattggaacgctggcttttggaaaaaaagaagatatggaactatatcttcgctctgagagttcagaagaaaagccttcttttaatgacccaatgctggtgtttgccggatttaccggacagaagcttgaccagtttttaaatgcgatgcgtaagcagaagattccaaaaattaatctgaaggctatgctgacagagcataatgtgaagtgggattcgatgactttacatgatgaattagctagggaacatgaggctatgaataaaaaataggaatttgccggggtgagtaaacagacgaacccccagagaaaatataccctatatctgtgactttagtcgcggcggtttgaatattcgcttaagtgctcgtatccaaaccttgctccgaggccacagatatagggtatattttctctggggttctggttgtttcaatccggcaaatttattaaaagatttggggaagaagtcaggagagatagaagtaattcgagtcaatccttcaaaaaaagttacaacgaaagctataaccttctggagcgtcctcaaatccctccaacaataaatagcaattccatccccagccaaaacacagccctctgtaagataaataaagcatatttgtggcctcggagcaaaggttggatgcgagcgcttttacgcgaacattcaacctgcagcgactaaagtcacaaatatgctttatttatcttacagagggtgtctcctttgcctgcggcaaattcctatttagatttagctgctgttgtagcttcactagaggcttctgttgtagaagcttcactggaagctgctgttgtctctgttgatgtctctgtagctgtggaatccgcactctttaaagatacctgtgcccagagtttctggtctacatctttattatagtcccatttcttctcaagtttcttagtccagttgtcatatttcttctggaaagcttcggactgtttcttttcttttaaagttttcttattgcttgctgtttcttctttatctgtgtaagcaacaagtttagcgataacgtatccgttgtcacattctaagactttatctgcaatatcgccatctttcatgctcttcattactttttcgaaagcttctccctcttcggattcgcctgctgcataggattcatctgtgttggagtaattctgttctttggcaactttcttaattgtcttcttgccgctctggatttctttgagagctttttctgcttttgctttcacggcctttttctcttttttactcatttctgttgtctggccgttatcacctgtctttgttgtggcaaatacaactctgtagattgtggactttcttgcttcatcgtctgttactgtaactttttctttgctttcaatcttcttctgaaccttagaagcaagtgtactgtcttcatagattttttctacatcttcacgagtagcaccacattctttcataacctttttaccagtcttatcctgataataggaaagtgcagaatcactgcactgctgtttttctgaatgagttaacttacagtcatacttatctgcctttttgataaggatgatgttctgtttcatctgggaaataacttgcttttttacatactcttcaaatgtctggtcattcccatcatcgtctttacccatggacatactccagaagtcacttccatagtaactgctataagtctgctcatactgtgcgctaagcatcttagcatacaaccatgcttcttttaatgtgacatctgttccgtcatagctgaataaaactttatttccatcctgtgtttttgttccttttccactgcttgatgtagaacagccggtcatgagactcagggccatgattactacaagaacgagggaaagaacttttgttaatttcgctttcatttgaacctcctataattttacactacatttttctattatagtacaaaaggaagaatacaacaagtaaattctggtttgtagggttagagaaagaaacaggaactctggtaaattatttttcagagggattgacacttgaagcaacttagtaattcctttgaattaacaggaaaatgctaatttttagctacattaccatacagattttgatattagttatttatgatccggattattatcgtaaaattgttgagatattgtaaccatagtttgaatgttaatctttaatatctcattttacgggaagccacaacctattagagaatccccaaatcctctaagataagttctgattttgcttctacagccaacgaacagtacccaaagagagccgataccctatatttgtggcctgggagcaaaggttggatgcgagcgctttaagcgaacattcaacctgctgcgactaaagtcacaaatatagggtatcggctctctttgggtgcgtctccttgcctgcggcaatcaggatttatcctgtagtttttggatttccccaatgatttccctgacttttgccagtaagtcttttttcggtatccctgtagattcgaacacaaacaccggattcgcttctggttttattttcatcttgttgcggtactgtttgaggaaaccgtcaatttcttcaacgcgaactttcgcccgtgggttcatggtaaacaggattttgcttcctttctgctcgatggaaagaagccatgcctgatgggcttcttctctaaggagtgcaacgtccatgaggcggatgagtggtgctggtgtatcaccgtaacggtcggtcatttcttcgatcatgtcctcggattcttcctgcgtctcgatagttgcgattcgtttataccaggagagtttttcggattcgctcttgatgtaggtttccggaatgtaagcatcgatggacaggtcgatggatgtggtaaatgtatcgacttcctgctgttcgcctttcattgttaatacggcctcgttgagcattttgcagtaaagatcgtatccgacggattccatatgaccggattgttctgcaccaagaagattcccggccccacggatttcgaggtcacgcatagcgattttgaaaccacttcctaagtcagtgaattcacggatagcttttaatcgtttttcggcttcttcttttaagatagagtttcttctatacattaagaatgcgtatgcagttcggttggaacggccgacacggcctcttagctgataaagctgggaaaggccaaataactgtgcatcctgaataatcatcgtgttaacatttgggatgtcgagtccagtttcgatgatggtcgtggagactaaaacatctatttctttattgataaagccggacataatcgtttcaagctggcgctcgcccatttgcccgtgtgcatactctactgtggcatttggtaaaagccgttgtaagcctgctgctacttcatcgatattgttgactcgattgtatacatagtatacctgtccgcctctgccaagttctcgttcgattgcttcgcggacaagttcctcgttgtactccataacgtatgtctgaattgcccggcggtccactggtggaacttcaagaacactcatgtcacggattccggcaagactcatgtgcagggttcttggaattggggttgcggacaatgccagaacgtcaacatctttcttcagctgcttgattttttctttctgttttacgccaaaacgctgttcctcatcaataataaggagtccgagattcttgtatttgatattttttgaaagaactttatgtgtgccgatgacaatgtcaatcgttccgtttttcagtccatcaaaaatacgtttttgttcttttggcgtgcaaaaacgagaaagcatggcaatctcgactggataatgttccattctttctttaaatgaattgtaatgctgctgtgctaaaatggttgtcggtacaagataaactacctgtttgctgtccataactgccttaaatgccgctcggattgcgacctcggtctttccatatccaacgtctccgcagataagacggtccataattcgatgactttccatgtcacgcttggtatcttcaatcgcgcttaactgatcttctgtttcctcatatggaaataattcttcaaattctttttgccagacggtatctttgccgtaagcgtagccttcttttgcctgcctctcggcataaagttttaccagatcctgtgccgcaatctgcacctgtgagcgcacccggcttttcgtcttttcccattctgtgccgccaagcttattcagttttggctttcttgcacttaaattcgaatatttctgaatgagttcaagctgtgatgccggaacaaaaagattactcgcatctttgtattcaatattgatgtaatctttcgtaattccatcggactcaattttttccatgccacggtaaataccgagtccatatttttcatggacaacataatcaccgactgaaatctccgaaagagaattgattttctggccactgtactggcttttcttcttcggctttttggcctttctttccttgaaaatgtctttttcggacaaaacgacaaatttaagcgtcgggtactcaaaaccatttccaagtcggccactcgccaccataatctcccccggtgcaatcgtgcggtcaaaatcagctgcaaaatacgcaagcagaccataatccctgatattttctgcaagacgcttcgcccttgttgttgaagaagaaagcagcaaaatcctgtaattttgctttttccagtgttctaaatccttgataagctggtcaaaactattattatatgaaaaaatggactttgcctcgatatcacaagtggttttcggcttgtaaaaagcgtaatcctgaataacagaactgagcaaaataagcggtcccaccatcacttttgacagaatctcctcatatccaaacagcaaatccgcctgtcccggcagcacatatccaccttctaatcgactctgcatacaaaggaaaaattcttcctcatatgtctttcctttttccagaacacgatgcggttcatcaatgaaaaagagtgtattttctggtaaatattcaagaaatgaaaccgttttctcataaaaataggacaataatgcctcacttccctctgctgttccaaaagaaagaagttcctcctctgtccttaccgtcatcttccgaagacgttctttttccgcaaaacgctttctcttcttaaatgcttcttcctgcttcttatactcttccttcattcggcgaactgcctcaccaatcttatttcttgaaagaatcatttctgtcgcagggtatacctgaacctcgtccagcttttccacacttcgctgcgtttccgtatcaaaagagcggatggaatccacttcatccccccacagctcaattcgaaccggaagttcctccgtcaacgggaaaatgtcaatgattccccctcggataccgaactgccctggcgcttccaccaggccactgttttcatatccaagctctgaaagcttgagttttaatgcatctgtatcaataattgattcaaaatcaatcgtcaggcaatgctccttaaactcctcaaacggaatcattttctccataaacacatcaagacaggcaacaatcgtgagaggctttccctccacaatcttttttaaaatgtccattcgctgccgctcaatgtgattactatgcacatctgcactgtaaaacagcacatctctcgaaggatacagcaccgtattcggatcaaaaaaactcaaatcctgatacagctccttcgccttctcttctttatacgtcaacacaaaccgacaaggaaaatcctcccccaaatttggaataaagtgtgctttttgagaatcaacacaaccattcaggacgatgggataagcctgttggctcattgcggtttttatatcaatataagtatcgaattttaaaagagggtttgataaagttttcatgatacctccttttattttggttgttgcacttttctgttgcatgcttgcttttactattatttatagcgcaacggaaaaatattttctcctattccaaagtttttctcttcttctttcctacgctatatttgttcatagcttctgaaaattcatcctgtgcaaaaagttctgctgctttttcagctttgtctaatgcatcggagagcagttctttttcgtcgtctttgaaatgtccaagaacataatctgcgagatcctgtcccggatgtttttcgccgccgataccgacacggattcgtggaaaagtgtctcctcctaaatgtttgataatgctcttcattccattatgtccgccggcacttcctttcgtgcgaagacgaagcattccaggctctaaactgatatcatcataaattacgaggatgtcgcttaaatccagcttatagaaatccatgattggcctaatgctttcgccgcttaagttcatataagttaatggttttacgagaagaactttgctgccaccgatgataccacttcctaccattgccttgaacttatgctgattaatattgattcgatttgcctctgcgatacggtcaatcgccatatatcctacattgtgtcttgttcctttatactggtctgttggattacccaatcctacgattactttcattctatgttcctttcgtgattttatttcttctgaggtttcttttgtacttttttcttcttgattttgtaactttaattgtttttgtttatttatatctttttctttttttgatgttaacttatctatacccgatataaaattgttatttttcttattcttttgcttagttacgtttgctgtctgctgttttaacttttcctgcattctcgccttttgctgctgtctttttctttgctttttgcgctcagactcccaggagtttacggcttcttcggcatcctgtgttgcccatttttcggggagttttccgttctggcttttgccggaagcattatcaaaaatattctggctgatgctgtcaggatttctctttctgcggtgttttgggcgatattgattccactcttcatagaatggttccggttctgacgcagaattcggcagctttttgccattgccgaaataatagtctaccactctctccgcagatttgtcatcaaaataatcgttgtgaagatgtgcaaatttctctactttcgcaatatcccactgtttatttttaatacagtcaatcaaatcctgcatattttctacgatcggaccgggtgccgtcttttcataatcaaaataaaaacctcggtctttacttaaataccattctttgtcaaatgcataaaggatgatctgacggtttaaaagagaatattctactgcaatcgaagaataatccgcaattaaaatgtccgtcatgcaaagaagtttgcggacattcggataatcggtcatatttgctacggtatccggcacttttgcagactgaatctgcggatgaagacgtaccattaagaaatagtctttcccaagttctttctgaaatgcatcaaaatcaaacgcttctaaaagctttttatcatgttcttcctccccacgaaaagtcggcgcataaagaacaagcttctttcctttcatttccggatattgttcactaagctcttccttccacgcagcaatatcatgatctctgaaaaaatagtccacctgtggacatccgatacagatcaccttttctttcggtgctataaaagcctctgcatagttgtccctgatattttctgaacttgccagtatgtggtctgtatttttcgttgccgctttaagctcctttaaaacttccgggttcgtctccgatgaaccgccaaacttcttaaaagatcccatcccatgccaaagctgaactacctttgtctcatccgacagcttcatatatccaagcggcaaaaaattgtcattcaaaaaaatatgggatgaagtcgccattcgaaaagcctttatagtaaaaagctttagcaagcctcccagattacgtagactcacttcataatctgcatgcgtaatgatattaaaatgaaaaggtaaccctcttttttcacattcgttttttatctcaaacaggcttcctgtacccccggtatttaatttctctatcagggtaatctgattctttttcactttccatttgcgaaagaaattaaagcaccctgcgaatattttatttgtattcaatgtatctaacctccactgtacatctaatgtactctcggaatctttttgtgccgttctgtaagatattgttaaaaatcaattctcgaagttctacttgatatttttccataacagcataaacaacatatgttttttagtatatcatagattatgcattttctaaaaagaaaaattttcgaatagcaaaatgactcttgcaatcttcaaaaatcttcataaaaatatagcaggaattccatatattatacagaaattcctgctataaggttaagagctgttttacgtcagcccctttatcttctaagttttgctacagttatatttataacgctacctctgcttctccgactgtttcctcttcccccgaggccatgattgcttcgtattcctgaagaatacttttctggatgatgtcacgagtatcagagttaatcggatgtgcgatatcacgatactcgccatcggatgctttgcggcttggcattgcgataaataaacctttttctccgtcaattactttgatatcgtgcacaacaaatgcattatcaaaagttacggatacgaccgctttcatctttccttcttttgctatttttctgattcttatatcggtaatctgcatgacctgtcctcccaataatgttgttactaattacagaatgtaccgtacattcttctcaattactatcttaacctcatcatcggttccgacgtagttcgttcctggacggagagtatctctgctctctacgatacagttctcaatataggagtcatctccaatatatacatcattcaaaatgatggagttcttgatagtacagttgtttccaatgtatacatctttaaagataatagagttttcaaccttaccgttaacaatacatccagaggaaataatactgttctttacttctgctcctgtattgtattttgccggcggaaggtcatctactttagagtatacgtctggatactgtttgaagaagtaatctcttacgtctttcttaaggaagtccatgtttgtcttaaaataggaatctactgttgcaatatttctccagtatgtatcgagtttgtaaccgtaaatcttacgaacatttctgtaacgaacaagtacatcctgtacaaagtcatgtctgtcttctcttgcacaacgctcaagaatctcaattaaatggcgtcttctgattacataaacaccgatagatacgttattagaggaagcaacgagtggcttctcttcaaattctacgattctttcgttctcatctaacttaagaacaccaaaacgtgttaaatcgtcatctgtatcttttaatgttgtgtaaactaccgtgatatctgcattcttagcgatatgagcttcaagaaccttgccgtaatccatcttgtatacaccatcacctgttgcgatgattacataaggctcatggctcttcttaaggaaatcaatgttctgataaagagcatctgctgttccctgataccatgagttattgttctttgtaacagtaggagtgaagacatagagtcctccctgctttcttccgaaatcccaccatttacttgagcttaaatgttcatttaaagaacgagcattaaactgaggtaataccgctactttagatacgcgggaattactcatattacttaatgtaaaatcaattgcacgatagcttcctgctactggcagggctgcaatcgcacgtttatcggataatcttccaattctgttattattaccacctgctaaaataatacctatagacttcatttatgtcacctgccctctactatctgataatggattcgccgcttgccagaattccgtctggataatcttctgctgttgtctttcctacgattgcgacattcttaccgatcttaacgttggccgggataacagaaccttcacctatagtaactaagccgccactataaaccttaggtttatacttgttctctgcttcttcaaatacaccaagctctgcgttctctccgacttctacgctctctgcaatgatagacttctcaatcttagcacccttcttaatcacggtattattcataataatagagttcgtaactacagcaccttcctcaatgacaacaccagctccgattacagagttggaaatctcaccgtaaacttctgttccgtctccgacgatgcaggcatttaccttagagtctgctgagaaatactgtggtggaataacgtctgtctttgtatatattctccagaactcttcgtaaaggttaaattctgggataatatcgattaattccatgttcgcttcccaatatgcggaaagtgttcctacgtccttccagtaaccctggtaattgtaagccataatcttatcaccgcgctggtggcagtaaggaattacatgcataccgaagtcacagccaggctgttcggataaagtttccagagcttcctttaatacttcccagttaaagatgtaaatacccatggatgctttattacttcttgggttcgctggtttctcttcgaattcgagaatctgattattctcatctgtaattaccagaccaaaacggctggcatcttcccatggtacttcatatgtagccagtgtaatctgggcgttgttcttcttatggaactcaagcatcagttcatagtccatcttataaatatggtcaccaccaagaataattacataatctggatgataatactccatgaattccatgttctgataaatcgcgttcgctgttcccgtgtaccagtcagtattctggctcttctcgtatggaggcagaatagaaacaccacctatattacgatccaaatcccaaggaataccgataccgatgtgctggttcagtcttaatggctgatactgggtaagaacacctactgtgtcgattccagagttaatacagttacttaacggaaaatcaatgattttgtactttccgccgaatgctactgccggtttcgctaattttgaggttagtacgccaagacggcttccttgtccaccagctaagagcattgctatcatttctttttttatcataataatcacccctttgtcacataatacttattatagcactgaaattcccaaatggaaagcagtttagcacaaaaaacaaaatatattttttatttttttatatattttgtatcgtccatatggttatcttttacatttaaatgtagaaatcccacgaaaacaataggacattataatgaaaagtgccctattactggctgttttaggaatttttcaaggtaccctggcacccttactataagatgtgtacagaagagaccttaagtatcgcaattctttcttgaatctcgtttatctgtgcgctatactataaacgactttttaataattaaactgatttttttcgccatatttatttatatgtactcactaagtcccatatgacggattttctgagacacatcttgtggcactggagggaaatatgtatacaattgattttcaaaagccgattcatgttcattttatcggtattggcggcattagcatgagcggtcttgccgaaattttattaaacagacatttcacagtgaccggttctgatatgcaggcttccgacatgacaaagcatcttgaagaaacaggtgcaaaggttgttattggacagaaagcagagaatattaccgatgatatcgatcttgttgtttatactgctgccattcacgaatctaacgaagaatttgctgctgcaaagaataaaggaatccctatgatgacccgcgcagctcttctcggacagatcatggcaaactttgcgaagtctatcgctgttgccggaacacatggaaagacaacaacaacttctatgcttactcacattcttcttcaggcagataccgatcctacggtcagtgtcggaggtatgttagaccgtatcggcggaaatattcgtgtcggccattctgacctcttccttacagaagcatgtgaatatacgaacagtttcttagaattctatcctttatattctattatcttaaatgtagaagaagaccatatggatttctttaaggatattgaggatattaagaattctttccacaagtttgcttctcagactgctgatgatggtcttatcattattaatggcgatatgggccacacagacttcatcttaaacggtcttagccagaagcacgttacttttggtttaaaccctgacaatgattacactgcagcagatattacatttgataaagagggaaatgcttcttataaccttatcgcacatggacaggaaaagggccgtatcactttaaaagtaaaaggccgccacaatgttatgaattctctggcagctattgcttgtacagaagcaattggacttcctttagatgcaatccgtaaaggacttttatcttttggtggaacacaccgccgttttgagtacaagggttctctcggtgatgtaactgtcattgatgactacgctcatcatccaacagaaatccgcgctactttatctgctgcaaaggattatccgcatgatgaactctgggttatcttccagcctcatacatacacccgtacaaaggcgtttctccctgagtttgcgaaagcattagaacaggcagaccacattgttctggctgatatttacgctgcccgtgaggtagataccggagaagtttcttctaaagatgtaatgaaacttttacaggaagatggacaggatgtacattatttcccaagcttcgaagaaatcaaagatttcgtaaaggctcacgtaaaaggacatgacctcctgattacgatgggcgcaggtaatgttgtggagattggagaagaacttctggctgaaaaataagttctgggttgccacagacaaaagatgccctcattaaataaaagaaactgttcacaaattttcagtatgataaagccatcaaaaaaacaacgaattatttttttgatagattttttcatactttcctctctttgaaccgttgaatagacggttctttttttgcaattttataacactcctataagcatcccgcagggcaaacaaaaattgtggataccaacttctgattttgcttcatcagccaaagagagcatatctgtctctgcagtaacccagaaagttatccacattatccacaattttaaaaaattttttgggagtattctgagtctttccccatgttgtttacattttgtccacattgtatttttgttcgttcacacctatatcttggaacttatcaccctttttgaccagttttctccccaaaatatcgaattccacccacctatccacaaagttatccacattatccacaaaagtgtccacattatccatcaaggttttatacaggagttatccccaattctatccacattctccccagattcgaaactgtattttttttggagggtgtgctattctatattacgaattattcagaatatactgatgctattttctggcatttgatatttggataactatttattctatagaatttacatttacaatttattaaaacgcacgatgataaccgataaactacagatgatagaaataaggggtataatgagcgataagattactttactttacaacgtacagaatgaagttactgttctgccaaacaaatttattgatgaatatatgataaaagcggatggagaatatgttaagatttatcttctgattcttcgtctgcagggtatgggattgcctgttgatgtggaacgtattgcagattatttagaactgacacgaaaagatgttttgagagcactttcttattgggagaaagctggtattttacggacaggagctgcttctgagacggctgctacggtgactggctctgaatctatggcaaatggaatctctggtgatacaggaactgctcaaactgttggaacttctggttctgatggaaatattataacctctggaacttctggttctgatggaaatactatggcttctgaatctacaggacaaactggagcttctctttcaccaacaatcactcctgtaccagataagaatacgttaagtcctacggaagtacaggcttcaatgacgaataaggatttagaacggacgatttatatggcggagacttatattggacggccattttccacaacggaactgaatagtttttgctatattaatgaccagctgcatttctcttctgatttgctggaatatttaattgagtactgtgttactcgtggaaagaagagtgtccgctatatcgagagtgttgcgattaactggtatcagcagggcatcacaagtgttcaggaagcaaaggaacaaagtacgctgtattcacagaatgtttttcctattatgaaggcatttggcatttcgaatcgtgatccggggtctgccgagcttgactacataaagaagtggaattctcttggacttggtacggatattattatcgaggcgtgcagccggacacttctggcaacgcatcaggcaagttttccgtatgcaaacaaaattcttgaagattggaaacggctcggtgtccggaatacttcagatattaagcatttagatgataagcatcgttctactgcttcgtcttcttcaggttctgctgccggatatacacagggacagcctcgtaaaggaagtattggggcagctgccagaaaaaatactgctacgaaccagttccacaactttgaacagagaacgtatgactttaatgatttggaatctcgtcttcttgataagaccaggaggtaagctatgggcatttccacaagacaataccaggatattatgaatgaatatgatgcagtacgccgccgcaattatatggcggaacaggaacgcaaagagcgtgtttatgctctgattcctgaaattcgtcagattgacgaacagattgctcatatttctgtggaaaaggcaaaggcactccttcttaagcaggtatctaatgctgaggcaaagaagtctttgcagaacacgatttatgatctttctatggaaaaggtcaacctgctggcgatccatgattacccggcagattatcttgacccgatttacgattgtccggaatgtaaggacaccggctatataggcgataaaaaatgccgctgttttcagcagaagattcgccatattctttacagccagtctaatatagaggatgtggctggtacagaaagtttttctgcttttcgcagagagtattattctacacaaagaagcggcagagagaagctttcccctcgtgagaatatagaaaatgtcttatcggcaagccattcttttattgaaagttttgactcaaaaccggggcagaatctcttgatttatggaaatgcaggtgttggcaagacattcctttcaaattgtatcgcgggagaacttctgaatcgtggaaaaggtgttatttacctgactgcctatcagttttttgaccagctagctgactatacatttcgccggggagcaaataatgcacagacattgcctgctttcctgcattgtgaccttctcatcattgatgatctcggcacagaacttaataattctttcattaattctcagctttttttatgtattaatgaaagaattctcaataaaaaatctactattataagtacaaatctttctttagaacagattaaccgttcttacacagaaagagttttttcaagaatcatacagtcctacacccttttacatatttacggagaagacattcgcattaaaaaggctttctcctcccttgacgaataagagaatggatgttataaaggaattgtaatatgatttatctcacataataataattatatgattaaaggagtaaaacacatgagaccagatgatagcaaatttgcaaccgttcctgtaggtaagcttggaattattgttcaccctagctgtgcagagcttggaaagagaatcgaccagtatattgtgaactggcgtaaagagcgtgaacatgaacacaaagagaatgttgtatttaaggattacgagcaggatacttatattatcgatgcaacctgttcccgtttcggaaccggtgaagcaaaggcactcatctccgattctgttcgtggcgtagatctttatatccttgcagatgttcttaattatagtttaaaatataaagtatgtggccatgaaaaccatatgtctcctgatgatatttacgcagatgttaagcgtatcatcggcgctgcttcaggtaagccaaagagcattactgttatcatgccgttcctttatgagagccgtcagcataagagaagctccagagagtctttagactgtgcttacgcattgcaggaacttacagcaatcggtgttgataacgttcttacatttgatgcacatgaccctcgtgtacagaacgcgatcccactgaaaggttttgacaatatcatgcctacttaccagttcatcaaagctttacttcgctctacaagcgatcttgagattgataacgaacatttaatggtaatcagcccggatgaaggtgctatgaaccgtacaatgtacttctccagcgttcttggtgtagatatcggaatgttctataaaagaagagattattctgttgtcgttgacggacgcaacccaatcgttgctcacgagttcttaggttcttctgttgaaggtaaggacgtaatgatcatcgatgatatgatttcttccggtgaaagtatgttagacgttgcaagagagttaaagagaagaaaggcacgtcgtgtattctgcatctctacttttggtatgttcactaacggactggaatctttcgataaagcttacgaagaagggcttatttataaggtaatcactacgaactgtacttaccagcgcccagacctctttgagcgtccatggtatgtaagctgtgatgttgccaagtacattgctctcttaattgattctatcaaccatgaggcttctatcagtgcaattctgaatcctcatgacagaattacaaagagattagaggaatataagcagttccatactattaaggaagagaaataggagtttgctagagcgtgtttgaaaaatgttctagaaacagacaccgctgaaaaggaagatattaaactgaattgtagttaatcttctaaagaaaaaaagaatttttataagtttgattttgttccgttgcgctaaacattccattctgcccagaaaaacaggaacttgagaaaaacgagtcccaagttcctacagtcagaattccatagcgtaaagtcacaaaatgcaatacttataaaaattcttttttctttaccatagttttcttacaattccgcatataattttgtttcagcggctggatgattttgatatataatatacttaattggacagccgggggacggcttcacctgttccgagtcttgcggaaggggtgatacatatggttacatatacggacttattcacctatacgataatgttatgtgctgtaatcacactagctattaatatacataaaaaatagccgtcctgaccctgcgaaagtcgacggctatcttttagtttaacacttatttgccggggcaggtggcgcaacaccttccggctgtcttgttaagtatagtatattctattcctttcctattgtcaaacaggtattttacctatgattgcgtaaagacaaacttagatttatgttctatttgacaatgacggcagcatagaacataatatacttaacaggaaagctggaaggtaaacgcaacttacccgtcctggcgaattaaaactatttgttaaatagccgttctattctttccagggagcaggacggctattttttatttactcccaaaactatccagccaccgaaataaaattttatgctgaattgtaagaacactatggtaaagaaaaaagaatggttataagtattgcattttgtgcctttgcgctgtggaattctgaccataggaacttgggacttatttttcccaagttcctgtttttctgggcagaatgaaatgtttagcacaactaaacaaaatcaaacctcgtattcttttttctttttcagatacttttcaacaatccgacttcaaagcacttcagtggtatttattctccattatcgggggttccactgtctccgttattcccgctgtcgcctccatcgttatttcctccgttgtccattccggagtcgttgttattttcattgtttccattgtttgcatcgtttccaccgttaccaccgttgccattattaccgccgccatagccattgttgttattttcggtattattgtcgttattgttatcatccggattataataatcctgagaagtgtcaggctctgttgtatcagcggctgtgttatcttcggttgattcggtggtgctttctgttgtgctttcggtgtcgtcttcggtagattccgtagttgcttctgttgtgctttcggtatcgcttaagtaggattcaaattctttgcgggttaatccctgatgaatcttgtccatgtaatttttccagatgcttgctggataggtatttccttttaagttatctacggatttatatttgtccattcctacccagactgcggtcgtatagtatggggtgtagccacagagccatccatctacatagtcattggttgttcctgtcttacaggctgccggcatatctacatccagctggcagacatgggcggttccttctgattctgttacacagctttgcagtacacttgtcatcattcttgaggcactgctggagtagacagactttgtcgatttatcttctggtacaatgtcgttgcccttggcatctgtaatttttatgatgcaatccggtgtatggtattcgccatcattggcgattgtcgcataacctgccgccatttctacaacagttgttccatttgtaaaaccaccgatacaggttgagttatattcataatctcttttatcgagtcccttgaaattcaatgcttcaagatacttcatacaactgcgtggcccaaggtcttcgtacagacgataggtcgctacattacttgacttctctaccgctcttctcaaggaaatggaaccagaataggagtagcctgcattcgatacggaatcgcttcctgtcatacggctgtcatctaaggtactatctggtgtatatcctttttcgagtgctggtgtgtatacgaggaggggcttaatcgcacttcctggctgacggaagctttggtaggctctgtttaaaccgtaaccttcctgatcttcctcacggccacctacgatggctgccacttttcctgtggagttatcaatggatacagctgctccctgtaccttgtaaacaccatcgtccgtcttttctgtaaacatggaaagctgggaagatacggaatcctgcagctgcttctgcttctccatgtctattgaagtataaatacgatagcctgctgaatataagctttttttgcaagtgttatacagctcatcgtattcattgttatatttttctttttctgaatcactggaaaatgttgtcttaatctcaaatccctgttgtttcatcaaggcttctgtcgcacattttaaaatgtatgtttccgcgtagtcattcgttgttgtctcttttttcggcatgatcgttatcttttcagcgacagacttctcatactgactctcgctgatatagccgtcctcatacatatttttgagaatgcggtcacgacgctttaatgtcgagtccttatgtttataaggatcataccggttcggactatttggaatagaacataaaaatgcaatctgtgaaatagataaatcttttgcatttttgttaaaatacgcttctgaagcagactctattccatagtaaccatttgcaaaatatacattattcagataaaattcgagaatttcctgctttgtatacttctgctctaatgctaccgcaataaacatttcttttattttacggctgtaagtcttctcataaccaaggaaaatatttctcgcaagctgctgtgtgatcgtacttcctcccattgtgatatttcctctatttaaaatgagggaaagtcctgcacgcgccactccctccacatcaattccatgatgtgtggtaaaattcttatcttctatcgaaataatcgccagctttgccgcatctggaatatcttcataatcaagataggaaacatccttttcctgctttaacttctttatctcattcccttctgcgtcatatacaagcgaggtctgctctgctttaaatgtgtctttactgctttttgctacatctttacttgcttccctgtacattgtaactacaggtactcctactctttttactgcaattactccaagtacacaaaaagccaatatcaggcaggttgcccagatcttaagcacccgccataataatccattatgtttcttactcatagtcacctccgcggtttcgtgtcttataagttctatacaggtttattataccatcttttctttatctttcccattctacggaaatttttgcactatatctgtccttcccttttcttttgctttatttccagttataatcagactatcattaaagtatatcacaaagaaatggagagattatgaacttaaaaaaaatatctggatatcgtttaaaatatatagctcttttttcaatgctccttgaccacattggagtaattggcagagcttttctgtcaaaaaacgtatattttctcctgcgggctgttggaaggctctctttccccctgttttgctttatattggcagaaggctttttccacacaaaaaacagaaaaaaataccagcagagactatttatttttgcacttttatcagaaataccttatgacctggcattccactatttacctgcttcaacacttaattccgttctacatttacaaaaactgtcacttactgacttttcagccgcctttcaagagcaaaatgtattattcactttatttttaggctttaccgctatgattttaatggaaaacgcctcacaataccgccaaaatgctttctatagaaactttgatattctcattattttctgctgcctcagtgaagtttttcagaccgactgcggggctgccggtattttgtgcatctatttcttttattcaatctataaaaaaagaggaagctctaccgaacttccaatcaaagcaggcttcatcggaactttgcccgctgcattaccgttactaacatatgtctctccgtttccagtgcagatatttgcccttgcggatagtttgcttcttcactgctacaatggagaaaagggccagggaagtaaatactttttctatcttttctatcccttgcatctgctgattttaagctttatattctgattttactagcggaagagacgcccgaagggaaggaaatactgcctatttgtgactttcgtcgcggcgtgttgaatgctcgcttacgcgctcgcatccaacacttgctcccaggccacaaataggcagtatttccttcccttcgggctatctttggctccagtgaaatcagtaaattcaaaacagaaagaaaaagaagatatatcaaacctataatttaaaaatgtctaatcagcaatataagaataaaatacctttcccgatttttctaagcggtttgtcacatctgttctcgatgcggctgtagatttaccggtgacagggtctaagtatcttatttttgttgcattgtagctcattacgataacgtatcggttactgtttaacttagcgagtaccgggcttccctgactgacatagtagaggatttcatctacggtacatcctgtaaggttgcgtgctgtgtgtccgctatatttcttcattaattgttcaatgctgccttttccgatatctatgctgtctggtgctgcttcttttccatttacagcagcaatcatagacagacagcctgcgagtgactttgcatcagactgtactttgacaacattgtccattccggctacctgggcatagtctgcgtaaatgcatttccagagaacattttctttgctgtctattacattgcctcgctctgtgtaagcccgcgcaatggcttcggtcaggttcgtataaaccgctttttgtgtaccggaagcatatacaaagtactgctccagctgttctccgctatttgaaagcttcaatgtaacatcatcttcatttaccataatttttgttaagagaagatctggaactacctgaatgtatacatagttcgggaattttaaataaagctgtgtccagtaggtatctgtatatttggaagtcagggttactgcgtcagattcttctttttctttatagcgaatgtaatccttcgttcctgttttctgaattttgcctcctgttctttttccgagtgtcatttcaaggatgcttcccttaatctgtgtggacataatatagcgcccggctttttgatattctttgattgtctttccgttaatatcaacgatgtgaattttggtaatcgggaagcttacggttccattactgctctttgaaacatttacggcatttgcctctccataaataaaatcattggataaaaagccaacggcacggattcttttatcagaacctgcggtaaagttctgtttttttcctgattcgagatctatcatttctatctgcttatttttataaagattttgctctttttcaattgcgataatgctctgatctttggaagcagtcagactctcattcacaagaccggattctaatattttatcctttttcttctctaaatcaatttcatgaaggtctccctcaagtatacaataaaatacggatttagagttcaaataggagaacttctctaaatcttccttcatgctgtcatacggcagagatgtggaaaggaaagaaatctcttcgttacagtttgtttttgcatcatatttcatgacttggattccattcattccttcatgtcgtccacggttaatatatccataaacaagatagaaaatatttcccttatcatccatgctaagcagcttgattccgtggtttcctgttgcatttcttatatcagaaatattttctgaagcaaggctgtatatcttgtacatatcagaagactgatagtcataataccagagctggccttccacagcaaagcacactctgtaccctttatcagaataaatgtaactgatattcttttcattctgaatacccaggctgataaggttattggccgaatcaatgatggattcattataataagcatccattgttctctcataatcaagaagatacatcctgtctgccgtataacgcagcttgtaggtctcactcaggtcataatactgaataacaccatcgcttatttctgtagaaaggattgtattcacccgaattactgtgtatgtgttgttcatttcctgaagagtaatacgtggctttgtttcctgttttacttccatatttccaaaggaaacggcttctcttccagagttgatacttactgattcgagattatcatctatcgtatctgcagatgtttcaagatagctggcattctcatccattgttgccttatcaaataaattattatggaattttaaaacaaatgcaaggtagtcatctaaatgataaccagaaccactctgtaccttcgtgtagaaataaattcgtgtgctgtcattcagtctgactgccattttaagataatatactttattttctgataaggtatttttaaatgtcagcgttcccagctttatatttttctttttattcttggtaagctgattcagtgttcctgtttctgtcggtttgtccggtgttttttcaaataatgtgtactgaattgccgtaatgtcataatcgtagtcatgaagctttaaaattacagcatttttattattggtaagggtaatctgattacggactaaagaaagatcaatgtcttccttatatccagccatcagattatagctgctcgtatcatttccaatctcaagaacaggataggatggattagccagctctgctactgcacttcccttttccatgcccatccgattattaaaaaagaccagtgcgccgatgaaacacaatacggcaactgctatgtgcaggattatcaactgtacatttttactcattattcacccctccctcttcctgaagaagcttccacaatgtcggggcaaatccaaactgttcacaaaatgcatttacctcttttgaagccttttctctcttctttgcggacggctttttccgatgtaaggcacgaattaaaaggttctttggtgtatgctccatatcaataaattctaaaatctgtgtatcgtatccctgttcttctaaaattttggcacggataccatctgttgcaagcgcacagaagcgctcttttaaaatgccataatctgttattggctcaaattctgatgcagaaatctgcttattaagttcatgctggcagcatgggacggataaaataacagatgcgccccagcgtaatgccttatacaaagcatagtccgtcgctgtgtcacaggcgtggagtgttactaccatatctacctgtgtaacgccttcaaattcttctatggaaccttcatagaaattaagcttatcatagccatacttcacagccagacggctgcagttttttataacatccttctttaaatccaaaccgataatacgaatatcataaccttttaactctttaatatagtagtacatagcaaatgtcagataggactttccgcacccaaagtcaagaattgtaatctccctgtccttcggaagatgcggcaacacatcctctataaactctaaaaagcggttaatttggcggtacttatcgtactttgtccgcacaatctttccttctgctgtcataactccaagatcttttaaaaatgggacagcaactccttctggtaaaatgtatttctttgtgcggttatgaagcaaatgacttttatctgatgacagctttgccacagccggattattctgcttctttactttaattgctgcctttccctttttgttgataagtgcagtaagctctgcaccagaagtctgcaactgtacctgtttatataagggaagtatcttttccacttcttctaataattctctcttactaagattcttatgaaaaacctgcgtctttgtatacgccgcactctgaaaaacaagtttgtccttcactagaatcgggcgaatattgtactttttcacttcttctgcttttcttggattacttatcgtgagaagaagcatctgctcatttaaattttctttgattttggtgagtaaaaactccatgtttattctcctgttatttatttcgataataaatgtatattatagcagtaaccacattatactgccagcgctttttccactatttattttcaatctatactcggtatttctccccggcagacttgcagagacgcgcatctcgcagcaagaatgccggggcattcttgaatattatactgaaaatatcagaacatctcttaaaatattcatcttgcggacataggaatcttttgcattattgtgttgaaaatactttctgtctgcggtaatagcgctgtcttctgtgattaatattccaatgtaatattacctgtatcaatgtgcgaaatggagtgatggcatcccggagagagacttctacaaagtatggatttcttatcatctcttcatcatcagcctgtatcatctcctgttcctcgcgatactttaacttatcatacaccatatccgcaatttttaaaatagttaccttgtctggatattcagaataaatcggacttcccttgtactcatattgatcaagcagggcatctccaacaatccacacctctctcgcgaccatcggcagcatctggataaaatattcgtagtctttccagtatcgctgttcttcctgttgtaactgctctggaggaagtaatgcctctatttgaagattttcattgccccagtcagtttcctgctgtgtattttgttcctcattttgacatgccatcatctctcgaaatcccggcagccattcaaaatcaaagtctccttttttattcatataatggtttcctgctttcgcccagtttgatttatcatatgcaaaatgagaatgattcgtgcttatctattatttttatcagacagatacaacttgttttcgattcataccgttattaaatatacggaattacttcttttaaattttccactaccgctacacatttttcctgctgttcttttggtattggaagcaaatctggaatgtttataacgggcagattacctgcaagagctgcctgcacgccatttgcggaatcttctaatacaagtgtctcttctggctttacatcaaatgctttgcaaatctccaaaaatacatctgggaatggcttgccccttttcacatcttttgaagaaagcaccatatcaaaatattcgtttaacccagttctgtccaggtattctttaataacatctgtatctgagccgctcgctacggctgtctgcaagcctttttcccggacaacctgcaaaagctctctcaggccttctttttcaggaactccttcttctctgattatctgtttggagcggttaccaacttttttgtaaatgccttccgcatctacatcttctccataataaacatagtatttcttctgaatgtcttttgcattcattcccaaaaatcctatatattgttcaaaggttggattatatccctcttcctttactatttcggtaaatgctctgtagtttacctgttctgtggcaaacattaaaccatccatatcaaaaattattaattttaacatatgtatccctcttgatgaaactggagaaaaccccgagatagctataactatttcggggttcgtctcctgatttaaatcaaaatctttctatctgtcgtgtttatttcttcctgttgctctgcgtcttctacgatatacttctgcacttcctgctgcaagggctgcggctgctaatgctgcgtaaaagaggatatgtgagttatctccggtctttgagtttttaccttttttggttgttttgttagaagagttattcttgctggtgcttgttttctttttctctttgccgtcatttccatcggtgtcatcaccatcgtcttcttttaaatatttgtcatactccggaataagaagctggttttcaatgacagcatatgctgttttctgtgttggagtaatctggcattttgttccattaccctcaatcttgcaagcttcggaagattctaacttattaccatcctcatctgtttctgcaacatagtatgttccgtctttgagatgttcaaatacagtgtatgctgaccatgcgccctcgcatttcaattcttttacattagaaactttctgtgtgcagtcggcatcactaaataatgcaacgtaaaaagttctgtttactgcctgattcctgcccctggaatgtaaccagcttacttacaacaagtttaccctcttcaccagctggtgttgtatcatctttcatgacaatttcgttgccatccactgctttaccatcaatagaaaccgttccgtctttatttacagtaaatgtaatatctgctgcaacttcataaccgcttggcgcagtaacctctgcaagtgtatacgtttctcccgcaatgagtttctgctcaaatacatgggcttctgtcgcagacatccagctttcgattacatttccttctttatcttttaaaagaagtctggcaccggcaacttcgttattgcctgtaatatccattttcttaatagatacttttgttacatctatttgtacccttaaaacggggattgaatgcgagcgttcccgcaaacattcaacccacagtgacagagtcacaaatataggatgtcgtctctctttaagggcgtctgtcctatctcataaattaaatagctatccctgcatcttttccatcagacgtgctgtatcttctgtcaatttctttaaggaattaaccatagcagctttctgtgctgataattcatcgcactgtttcttctcttcttccactttacgaaggctgtcctcatgaattttcttagcttcttcaatggcattttccttattttcctgtgcatcttttaagagtctttcggctgtttttcttgcttctccgataatatcggctgcatcctgtcttgccttttctctttctctttctgcctgttctctggcttcatctagaattgcattctgtcttccttctaaatctgacagctgcttgcaaagtaaatctgcattcttcatgtaacgctcataagcctggtctgttgtctctggtgctttattattctcggcagacttctccgcttcttcggcacgcgctatcgctttctctgttttttctttttctgctgcaatttctgcctctaaggcagctactttcttctgtgctgctgctaactgtgcccttacagtctctatttcatcctgtacttcatctgcatctgctacagctactgctgatattggtacttcattagatacggtttcctgtactgtttcttctgcctcatctaatgttacagtttgctcatcttcttctgtctcaacgatgtcttcctgtgtatctttttccagttcttccatcgtctttcctgtagctgctgccgcaataccaagagctgtcttgctctcctttttcagttcttctatctctttttctttcgctaaaatgatagcttctgcttcatcacaaattttatctaactgaatatcaacttcatctttatcataaccaaacatagatgttttaaatgtcagttcttctacatatgttaacaattcctgcatattcatagcggtttcctctcttcctctggttcgtgtcgcgcagtgtacaattccagaattattcaaaatcatttcttactatttattataagcattctatagtatttgtccagtgaaaatggcgcgaaaaccttcagtatgccagagcgtgtttgaaatactttctgcaaattagaacatgcagattgcaagaatgatttatcaaaccctctcagctcattaatattaaaatgtcagtcgcatctgataccacgtagctccaccatgtattgattctgaaacaccttcattctgaaaaccaaatttctcataataatgaactaatttatccttacaggtcaggaccaggccttccctgtcctgtgctcttgcatcattgattgcgtagcgaagcagcttttccgcatagccctgtcttcgatatttcggcaatgtatttactccgaaaatcatctgccacgctcccttttcatcatgaaggcaagccttctcatacatttcatctgtcagatttttttcatccgttaccattccatctacaaacgcaattactttctcttcctcacacatcagccagaaatgggttccatattccttaattctctctgcaaatttttcttttgtcgccgcctcctcaaaaggaaaacattctgactccacaaaagcaatcttatctaaatcttccatcgttgccattctaatctgcatgtgttccataacaataagctcctcattcatcataatcttgtaatcttctttttattttctttcgaaaatatcacaatatctaatatttgtaatacacatttggtactcattttaccttttataacatattataaattacttttacaaaatttcaatgttcatttttaacaaaaaaggggatttcgttgctgtggtatttgaggaagggggggatggagacttctacttattctgaattttatctgccattccatgttttcagctaatttctatcttccacccaacaggcaattaccacaacaaagcggcggaaataattctgctgggctcatagacagaaagcgaagaacaccatattctcctatctgtggcctcggaacaagcgttggatgcgagccttaaagcgagcattcaacgtgccgcgactaaagtcacagataggagaatatggtgttcttcgttttcatctatcttactataaaattatttccccgccacatccaatctggtaattgctctcttaagggcgagttctgcgcgaccgatatcaactcctccctgttcggaagaaagtctcctctccgcgcgggtcttagcttctttggctctattgacatcaatattctgtggccattctactgcttctgcgagaatagtcatcttttcaggagtgatctccacaaagccggaaagaagtgcagcctgtttctcctcattcctctcggtaatgatgagcctgccaggtgcaatgatctgcgtcatcgggatatggtcggcatagatacccacctctccctctacggtattatattccaccatgtagatgtcattggaataaaaaatcctgtccggtgcgatgatttcgagtcggaatgttttgtctgccatagaatcacctacttattatatctggctaatacatcgtcgatatttcctgcatttaagaacattccctctggaatctcgtcgtatttaccctcgagaatctccttgaatccctgaatagtctccccaagaggaacataacgtcctgttgttccggtaaactgctctgctacgaagaatggctgagataagaatctctgtacctttcttgcgcgggctacgagaaccttttcttcttcggaaagttcgtccataccaaggatggcaatgatgtcctgcagttctttataacgctgtaatatttcctgtacaccacgggctacctggtaatgttcttcacctacgattcgagggtcaagaattcgggaagtagactctagtggatctacagccggataaataccctgttctacgatggcacgggaaagtacggttgttgcatccagatgagcgaatgttgtagccggagccgggtcagttaagtcatcggccggtacatatactgcctgtacggatgtgatagaaccgttctttgtggatgtgatacgttcctgtaatgctcccatctctgtctgtaaggttggctggtaacctaccgcacttggtactcgtcccagtaatgcggatacctcggaacctgcctgtgtgaatcggaaaatgttatcaatgaataaaaggacatcctttccaccttcatcacggaaattctctgcgattgtcagtccagtaagacctactcgcatacgtgctcctggcggctcgttcatctgtccaaataccatcgctgttttatcaataacgccggactcactcatctctgtatagaggtcattaccttcacgggtacgctctcctacaccggtaaatacggaatatccaccatgctctgtcgctacgttacggattaattcctgaatgagtacggtcttacctacaccggcacctccgaaaagaccaatctttccacctttctggtaaggacagagaaggtctactactttgataccagtctctaagatttctgtttctgttgcctgttccgcaaaagtcggtgccttacggtgaattggatttctctttactccttccggcacaggctttttgtcaattggctctccaagaacgttaaagatacgtcctaaagtaacctcccccacaggtacggtaattggtccgcctgtggcaatggcctccattcctcttacaagtccgtctgttggacccattgcgatacatctgataatatcgtcaccgagatgctgtgctgtctctgcaaccagcttggagccatcttttctacggatttcaacggcatcgttaatttctggaagaacaccctggtcgaatcggatatcgagtactgcaccgataacctgggtgattttacctgtattctgttctgccatttatttactcctttaatatttgttaattcagagcttccgcacctgaaataatctcggttaattcctgcgtgattgcaccctgtcttgctctattataagcgagggacagagtggaaatcatctcctccgcattgcttgtagcagcatccatcgcctgcattctggctccgttctcacttgctactgcctcaataaatgccccatatataatactatttatatactttggaatcagcaaatcgagagattcctctgcttccggctcatagttcatcggtgcctggctctttttctcgctttcttcctctgccttcacttccacagggaggagtttgataaattctggtgtgtgcactaccgtatttttaaatccggtatacgccagataaatctcgcctatctctcccgctgcataagcatcaagaactttacgtccaatctctactgcatcagaaaagaggggttcattgataatatcggaatcatcggatgcgatatagtatcctcttcgctcaaaggattcgataccctttttaccgattccgtaaatctctacactctcttttggaagtccgctgtctgcgacaagctttacaatgttattgttatagccgcctgcaagtccacggtttgaggttacaacgattacggcttttttttctgagccgttaaatgtcaggtaaggatgttcgatattgcctgattttgagagaatcgactgcaccgtatcgtacattttctggaaatacggctttgcactctccgctctggttctggctttctgaagcttaacagtggatacgagcttcattgctttggtaatctgctgcgtactctgaatactttctttccgcctcttaatatctcgcattgatgccatattcaatcaccatccttaaaattgattcttaaattctgtaatggccttctgaattaacacatctgtctcactgttgatttctcctgtttcacggattgccttataaatctctggatactttgtctctacaaattcataaagtcccttctcaaactctgcaatacgctctactggtacatcaagaagatactttctcgttaccgcataaatgataacaatctgtttctctacagcaagaggctgatactgtggctgttttaatacttctttaatacgctcaccctgtgcaagacgttctcttgtatcatcatcaagttcggaaccaaactgggcaaaggacgcaagttcacgatactgagcaagttctgtacgaattggacctgcaatcttcttcatcgccttaatctgtgccgctccacctactcgggatacggaaagacccgcattaatcgctggacggaaacctgcgtggaacatctccgtttccagataaatctgtccgtctgtgatggagataacgtttgtcgggatataagcagaaacatcgcctgcctgtgtctcgataatcggaatcgctgtaagtgaaccaccgccaagttccttagaaagtcttgacgctctctctaataatcttgaatgaagatagaatacgtctccaggatatgcctcacgtcctggtggtcttctaagaagtaaggacagggtacggtatgacgtagcatgcttacttaaatcatcataaatgataagtacatcctctccacgctccatccactcttcaccgattgcacatcctgcatatggtgcgatatattgtaatggtgctaactcgctggcagtggaagcgacaacggttgtgtattccatcgcatcatgttcttttaatgtctttacaatacctgcaactgtagaagccttctgtccgatggctacataaatacagtgcatattctgacccttctggttgataatcgtgtcaacggcaatggccgtcttacctgtctgacggtcaccaatgatcaactcacgctgtccacgtccaattggaaccatggagtcaatcgccttaattccggtctgtaccggagtatctactgcctgacggtcaataacaccgtaggcaactctctctacaggacgatatttatctgtatcaattggtcctttttcgtcaatcggctgtcctaatgcgttcacaacacggccggtaagtgcatctccaacaggaacttctactactcttccagtagtctttaccacgtctccctcgttaactgcacgggaatcacctaaaagtacaacaccaacgttgtcttcctctaagttcatgaccatgccgtatacttctcccgggaattccagaagttcaccctgcattgcattctccagaccatgaatacgcgcaataccatccgccacctgaataacagtaccaacatcggtggtttccagcttcgccgtataattcttaatctgttccttgattacggaactgatttcttccggtcttaaattaaccaaccccaactacaccttctttctccaaactcaactttgataatcccttgctgagcttctcaatctgcgttttaagactgctgtctaacactctgtcttctattcggatgatcagacctccaagcaatgccgggtttatctgataatctacttcaaaggaagtgtatttcgtcgtctctaaaagacgctttgtaagtttttccttctggcgggcagaaagttctgtggcagaaacaacctttaccttaccaattcccttatattccttcgccttgtctacgaaaaattcaaaaatctttggaatgtctttctgtctgtccttctccacaataatgctgagaaatcccagcacctcatccgatgcccgtccggaaaatatattcttcagcaagtctaacttctctatcttgcttacttccggatgatttaaaagagagagtaagtccgcattctcaagaagaatctgctgcaatgtctgcacctctgataaaagggcatccatcttcttctcctcgactgccagctcaaacaaagcattgccgtaaatactgcttactcgtttagccatgttttatctcccatctcttttaatgtctgctcaaacagagcattctgtgtctgctcatcaacagatgcggcaataatcttctctgacataagcgcggcaacagaaataatctcctgttttacttcatctttaacacgcttcttctcaagctctgcctcactctttgcattctccatgatacgggctgcctccgctcgtgcgtctgcgataatctcattctcccgctgcatggccttctttctggcatcacttaaaatctgttccgcctctttatcaatccgtttcagcttcgtatcatactcatccttaaaacgaattgcctgttcccgactctccttcgcctctttttgctccttcattacccgctctttacggtcattcaaaatctttcttaccggatcaagaagcagataacttgcagctaaaaataaaataaagatggcgagcatctgaaatgctacctgaaatacaagctgtgggtccaggccaaatattctgttatcatactttagtgcctctaataacactttatggcctcctttcgaattctcgaggactcatcttacagctttccgattaatgggttagcatacagaaggatcagtgcgataaccaatccgtaaagacctgttgtctctgctacggcctgtcctaaaagcatggtagacataacatcaccctttgctcccggattacgtcctactgcagaagcaccataaccggctgcaataccctgaccaacaccaggtccgatacctgcgataaccgcaagacctgcaccaattgcggaacaagctaaaactaaaccttcgtttgtaattcctgtcataataaactcctccttaaatacattctctttcttttgtcagaaaacctgtaaacaaaccgttacagtctctcctaatcataacggtttgatatgaataccattgttaacattccaaatacatatgtctggattgctccagaaaagaaatcgaaatatgcatgtagaaatgccggtattccaatctttgtaaaccacggcatcaatgcgtaccacaggccgagcataatcgttcctgctgttacattaccaaacaaacgcagtgacatggagaccggagtggcaaactcactgatgatgttaatcgggagaaagactggaaacggatctaataaatcttttatgattccaaatccctttgtctttatccaagcatactcaatcatcacaaatgtaatcagtgccagaccgaatgtggttccaaaatctgccgttggcggccgtaatccgaaaagtcctgaaatattggataaaaagataaacgccatcagcgcctctacataattcaggtacttctttgcgtgaatacccatgttgctcacaaccatggcatccatcttctccactatcatctctactacattctgcacaacattcggttcgtcataatctttcatgatctcatgtctggcaaataatatcaaagccaataatatcagacaaacaattactgtcgtgaccatcgtagtattgatagagagggtaaccccaaacagcttaaattcataataactatggataaaaaaatccacatcgctgcttcccatacctttaccttcctttcttatataatttctttgttatatatacattagtatatgcatgaaaatatgcagatattttcagtcccagaattccaataattattcccggaaaactaaaatatcctgaacgcattccaatccatgcagccaataatataaccactgcccttaaaagcgtgctaaataccatgttcctcctcgcctgatgttccgtcatcacaagacaattgttcagactcttgtacatactcacgctaagtcctatcgctacagctgtcccaagtaacagccccagactgtagctttctttattctccacgacaagaagccctatcgcttcaaaaacaatactgtacacaatacatccgaaaattaaatcaaataaagtttcattatctttatttatccatcttctccagttcacctttatctgattcccctttcttcactgtatcacaaatcagctccaaaatattatacacattatattattaagtataaaacaatctattttataaaacgcaaaattatcgtataacaggaacgaaatcctgccagtattcccaatataagaaataccagaaaaatccaatctgcatgaagcctttcagctaaaaacttcccggcaatcatacaaagaaaaatacaggtcaacatgctgattcccaattgggtaatcaatgcaagcatcctcaaaaaactatagtctttcttctttcgaatcataccagaagttctccgataatccggtctgcaacggcttccatcaaaggctccaatatatcaaagcaggtctgataggtctcctgattctcctccgtcacttccggtattctctcttctgtttctgttgtatctataaatgtcccaattgacatacagcttgttgcctcgtcaaatgattcctttatctcctctgcgagtccttttgtaatagccagcactaaatctgctgatgcaagatcctcgtctgtgagctgggaagaacgaaaatcttctatcctatagcctttttcccttaaaatctttgctgctcccggagcaacaggttctgaaaaaagtacaaccagtcctctggaaactacctctatattctggcagtttctcttctgtaatataccccgtaaaatacattctgccataaagctccggccaatattgttctctcccacaataataatcttacgataatccaaactgatccctcctatagcgtaatcagatgatatccggctgcctttagcatacggttcatgatagcattccccaaaccttgctcaaaaaaactctctgaatacatataatcacattctaaatcgtcaaattcccgaagaatacggtaaagattcgccgcaacagtttctggtttctgccgacttcctatacttcttaaaatatctgcatgataggaatctaatgtctcatctgttccaataactcctaccttatgtccttcttcttctttctccttaacaagttcattaatccgggcaatcaccttatccctatcgccttctaccaatgtaagctgtccctttggcgcataatgacggtacttcattcccggcgctttcgctaccacattcttcttcatagtacgtccggtaactgccggatcaatattcactttaggcagcacttcttctaacatatcttttgtaatatatcccggtcttaaaatagtcggggtatctgtactcatatcaataatcgtggactcaattccgattccaacagcccctccatcaagaatcaatggaattcttccctgcatatcttcatacacatgagatgccaatgttggacttggccttcccgaagtattcgcactcggtgctgcaatcattcggccactctcccggataaaatcacgagcaagcggatgggatggcatacgaatcgcaacagtcttaagccctcccgttgttccatctggaacacagctctttttatttaaaataactgttaatggacctggccagaacttctccatgaccttcttcgccgcttccggtacctctgacgcaatctcatacacctgatcaacatcatgaatatgaacgatcaaaggattatcggacggtctccccttcgccgcataaatcttcgcagacgcttccgcattcaatgcatctgctcctaagccatagactgtctctgtcggaaaggcaaccaagcctccttcccggataatctctccagcttttttcagtgctgctgctttttcctctggcgatactttctctatatttaataattctgtctccactaatgttcacctctggtaattatatttatatattaatcgaacgctgcctgactggccgcgtccccatacttaatatgtataaagtcaatttctaaaaaacagattaattgacccttgcatcatatcacgttttggctataaagtcaaaaataggctcatttttatcggcatttttcagcattttgacactttttatcggttatgatgcttttacctctttcatatacataataaagaaacgataaattaaggatgaacattatgaaattactctctcatcccatcattctgtccgtattcttactatgcttctgtgctggggcattctttatcggccatgcggcactttcctacgctacgttccagtcagcagaaaacttctgtgtccttcttgatgccgggcacggaggaaatgatcccggtaaggtcagttcttccggtgtaaaagaaaaagatattaaccttgccatcactttaaaatgtcaatcagttcttgaacaaaatggtgtaaaagttatcctgacccgaaatagtgattgcagcttagcagattcgaatgcctctaataaaaaagccagcgacttaaaaaaacgaaaagcacttatcaaagaaagccaaataaactgtgcagtaagtatacaccaaaacagctttcctgatacttcctcacatggagctcaggtattctatcatccgcaaaaccctgacagcaagcgtctggcttctcttattcaggcacagatgcaaaaccttaccggcatccaaaaccatcgcaaaattaaagcaaacactgactattacctccttcgtgataataatactccaactgttatcgcagaagtctgctttctttccaatccatcagaagctgccatgattacagaagagacaatacaagaaaaagctgcctttcaaattgctatgggaatcatgcagtttctacattctccttcttttaatccgcagtaaatatctcctaaactaaagcaaatatctgctaaattaaaaccttcctcttctgtattatttattcttttataataattattccagagtatgtttgaaaaaagctttctgcaaattcaagaatgccccggcattcttgccacgaggtgtgtatactgcaggaatgattcttcaaacctgctctaatgactatggttcacaatattatctgggaataggcttcatccgaaatctgcttttaaaatttataatacctgccgattacataaaaaatgtagttatagtataccaatcctcctgtgaatattcattatcaaaaatactcgtatcttactgccgccttattatactgtctcttcttcgcctgaaaatactggcgcagatacactataccatttttgtttttattttacaatattttcctctaaaattttctttcctttttcttaaagtgcaagaatccgctgtctgcggcacattttaacactttacagtttagggaataatgtttatactatacacacacagatatctgtcagcacataaacggctgtcttattacacagcccacatataatctactatataatttgtaatcagctgccatttgtttatacacggcaatagctattctaaaaacattctaaaaatgaaagaaaagtagatttgtgattaagattcatttatttgtacccgctgacagattattttttgaaaaaggaagtgatttcatgaagttagagaaattaagtgacacacaaatacgctgcactttaagtaaagaagatttaagccagagacagcttcacctttctgaacttgcctacggttctgaaaaagcaaaagaattattccgtgatatgatgcagcaggcatctattgagctcggtttcgaagcagataatattccacttatgatagaggctattccaatatctaatgactgccttgttttagtcgttactaaagtggaggatcctgacgaacttgacactcgcttttcaagattctctaaaataaatgtggatgactcatttgacgaagatttttctgacatagatgataccgattttgaagaaatggatttcctcgacgatgaggacgatatagatatggacgatgaacctcttccattcagcccttcttctgattttgacaatgctgattctgatgcttccacttcttccaaagaacgttctgctattgatgatgcattagacctgattgccccatttacccaggcaatcgctcaggctaaaaaggaagccatgagaaagaaaaaggagaaccgttcttctgtacaggactgccagtactattctttccagaatttctcacaggcagcacagcttggcgctttcctcgctccattttttgagggagaaagttctttgtacaaagattctttttccaataattattatatgattcttcgcaaaacacaaagcgaaaatgatactttccaccgtgcttgcaatatcgcagctgattttggcgtgagaatctctgcttcttatgcgacaccagcgtattttagggagcattttgagacgatactggaggagaatgcagttgagatgctgggggaattggcttaggtttggaatgacttataaatagacgaactccgaaagataaataaagcatatttgtgactttcgtcgcggcggtttgaatgttcgctttaacgctcgcatccaaaccttgctcccaggccacaaatatgctttatttatctttcggagttctgtttttgggttgcttaagttactgaaaaatctatagctgatttttcagcattttaacggtattatcttgtagtatagctgaaaatgctgaggaaagggatttgaggatttttcgaggaagtattgctttccgagttttgttttttagaatgtttttgaaaaatgctttttgtaagatgtatgttacaatttgtggagaatttttcctgaatgaggacggtgtaatgtgctacgtcaactgaataaactaattttctaacagctaataaacctccaacagccaaaaaacagctcccaaagagagaagaagccctatatttgtggccttagagcgaggattgaatgcgagccgttaagcgaacattcaacccgcagtgatagagtcacaaatatagggcttcttctctctttgggagcgtttaccttgcctgcggcaaatcaggaattatttatccttatttgcaaggtaatcatttacgcgttttaatacctgatcagcgtccattccgtgtaccatgcaagcttcttctaagctttccattgcagaagatgggcatcctacacagtgcattcctgctgccattaagattgctgcaattcccatatccatctgaagcatttcgccaattaatgtctgttttgtaatctgctgtgccataatatatacctccagttcgtatatcgtgcctacgcattcttaaccattttaaagtatgctgtactgatattatgtctcattatatctgtctttaatgtcctcaagctctttaaaagaaatattaaaaatattggtaagcgtttttacttgttttgttctgacttttgcaagcctgaatttcagtataatacatgaaataaaaaagttcaactgttatatttgcagttattcctgattatttctcaaaaagctatttttaaggaaaaatttctaatcactcaaaatctctatatccgtattttaatttactaccgttagagcgtgtttgaaaaatgctttctgaaagatgtgcgttacaatttgtgggagatttcgcctgaatgagggcggcgtagcgggctacgtcaactgaatgaaggcaaaatataccgcaaattgggatgtgcagattgcaggaatgatttttcaaacatgctctaggctataaaaacaaatcagacggaacaactgctagttaaacagatataattaattctcaatttccttaataaggttaatcatctcgattgcacttacagcacagtcataacctttgtttcctgcttttgttcctgcacgctcgattgcctgctcaatattttctgttgtaaggattccgaacattactggaacgcctgcctgtaagccaacctgtgcaacacctttagatacttcgttacatacataatcatagtggcttgttgaacctctgattactgttccaagagcgattactgcatcgtattttcctgttttaaccattttctcgcagattaatggaatttcgaatgctcctggtacccatgctacgtcgatattttcttcggagattccgtgacgtacaagaccatcgactgctccgcctaataatttagatacgataaattcgttgaaacgtgcacatacgattccgattttctcttttttacctactacttttccttcgattacatgataagccatctttttatcctccatttattttaaatatttaacaagttgttctttataaagtctgatcgggtcaagctgctttatttagtattttgtataatgtcccatcttctcctgttttgtcttcaggtagaataagtcatctgagtttggctcgatgataattggaacacgttctacgatttcgatgccgtatccggataatccaactactttggccggattatttgtcataagacgaagttctttgattcctaagtccgcaagaatctgtgcgccgattccgtaatctcttaagtcttctgggaatcctaatgcaaggtttgcttctacggtatccattcctgtatcctgaagctggtatgcttttaacttattgataagaccgattccacgaccttcctgacgcatgtataaaagaacgcccctgccctctttttcaatcatctggatggctgcgcggtactgctgaccacagtcacagcggcgagaacctaatgcatcacctgtaagacattcagaatgaactcggcataatactggcttaccgtctgatacgtcaccttttacgatggccacatgatgctcaccatttaacttattgatgtatccgaaaatacggaaatgtccataatgtgttgggaaatctgcctctgcttcacggcttacgaaacattctgtctttcttctgtactgaatcatatcagcgattgtgataagctttaagtcgtatttctttgcaaattctacaagatctggaagcttgcctacgaatccgtcttcgtcgaggatatcacaacaaagacctactggacgaagaccggccattactgctaaatctacagctgcttctgtaaaaccagttctctttaacacgcctccctgtcttgctaccttagggaacatatgacctggcatacggaaatcttctggcttagcatctgcttttgtcgcagcgataactgttgcagaacgatcctgtgcggaaattccagtaggagcatctgccttgtcaaaagatactgtagatacagatggttctccatcagaaccctgccagattaaggcttctaagccaagctgtcttgccacttcttcagaaattggcatagtgatcaaacctttggcattggttgccataaagttgataacttctggtgtggcaaattcgccggctaccagaagggaaccttcattctctaaatcatcgtcatctactgcgataaccattttgcctgctttaaaatcagcaattgcttcttcgattgtgttaaacttaatgtcgctcatttatcttaggtcctcccttaattagaatccattttgtatgagaaaatccattgtaatgcctgttttctcagtcgtgccttcttcttcctcagcaggaatacttccgtactgaagaagcttctcaacatacttgcctaccatatcattctcaagatttacggtatctcccggctttttatcaagaagggtcgtattctgtcccgtatgtggaatgacagaaaccgcaaagctcttattatctacctttgctacggtaagacttactccatcaatagtgatagagcctttacttatgatatattttaatattgctgcggatgtatcaatcgtaatccatacagcattatcatcctttttcatggaagaaatagttccggttccatcgacatgacctgccacaatatgtccgccaaagcgtccatttgccgccatcgctctctctaaattaaccttacttccactcttcaactcgccaagattggttcgccttaatgtctcatgcatgacatctacagaataattattttttccgatggatgttgcggtgagacagacaccgttaagtgccacactgtcaccaagatgcagatctcctaaaacagtatttgccttaattgtaatgacagcggaattcgcaccttttttgatgctctggatttctccaacttcctcaataattcctgtaaacatacaacctgcctttctattaattttcttttgttctttcatattctaaaagaatatcctgcccaaattcctgcattcctattctggtaaaatgccatgcatcggcagctttcgcaagtccctgaccttctaccggagtctttgcctgtgcacctccaaaaatcttaggagcaatgtagcaatatactctctgtacgattcctgcctgcaatgcactctcgttaagctgtccgccgccttctaaaagaataccgtcaatcttacggcttccaagttccttcatgagaactggcagagaaattacttctttttgcttctcttctataatatcactatcgacttctctgctaatattattatctgctaaattatctgccaaaagtctgtccttatattttaaaactgaatctgaactgcttcctgaaaagtcattcaccgcaattcccggaatccttaacacttccacacccttttcttcaagctgcaccgcctttgtctcatcggcatctggcaggcaggctacgataagaggctgttgcttcgctgttcgtacaagctgagaatccatcggaatccgcaaatggctgtctgcaataatacgaaccgggtctcttccaccttcgatacgacagctgagcatcgggtcatcagcaagaactgttccgattccagccataattcctttataatgattgcgaagtgtctggacatgtgctctggactcttctccagttacccacttggaatctccagtatagcaggcaatcttaccgtccatagtcatcgcatacttcattgcaacataaggcgttcctgtactgatataatggaaaaacacatgattcatggcatcacattcttccttgaggaaatgtgggataacttcgattcctttttcacgaagaagcttaaatcccttaccggataccagcggattcggatcatcagaaccaacgacaactcttgcaatcttctcctcaataattgcttctgtacaaggaggtgtctttccgtaatggcagcaaggctctaacgttacataaatggtacttccctcaatattattgcctctcttcctggcattcgctatcgcattacgttctgcatgaagctgtccgtaacattcgtgataaccctctcctataatctctccatccttcacaataacggctccgactaatggattcgggttcacatgaccgcttccttttttcgccagctctatggctcttctcatatacttctcttctggcatatctaaaacctcctgcaagtaaaatcagatcagaaagaagccagtaaaaattcgtccatctaaatatcagacagctatataagcgattcctctttctataagaaaatgctttttacattatataaaaatacttcctggaaattatataagcttatataaaagcactttcttggaaataaaaaacgccctgaaatctacgtttataaattccagggctttaatttatcttaatcgttcatatacttacatagtctctttcttcttcttacatccggactgtaccgtcggctccggaatcacaccggatcatgctatcgctcgcgggcttacgcttcctcctaaaacttcaaaacgcttaccgccggtcgggaattacaccctgccctgaagaatattttatttccatcggtattatatcgcattatgctatattattcaactgttttttatacattttccacaatgagatatgtacaaaagttccaatccaaccttaaataacgctacttttttgcaaatgtaatccttattataaatcttgttcaaagtttgttacaaatcaaactattatgtttttaaacacgctctagagcgtgtttgaaaaatgctttctgtaagatgtgcgttacaatttgtgggagatttcgcctgaatgagggcggcgtagcgggctacgtcaactgaatgaaggcaaaatataccgcaaattggggcgtgcagattgcaggaatgattttttaaacacgctctagtttccgcctgcctgctgttcatatgtactgataagctgtatattgtacttctccacttcattcaggcaagaatcatcaaagtcattcgatgctgtctgtggcacataccagttctgtctctggaaatactcctgtaactcctgatcattaaaaattcttccgtgtcgcgcatagatttcattcctcgtaatcttcagtccataggaatcaagtacagaaagattctgtatagtatacttaaccgttgtcgtataagacaaatgctgtgccttctcatatcggtttgagctcttatcatcccctggaataaggtaaatcctgtcttctgtctcaccatctgcttcttcatcagatgaagcgttttcattctcatcagcactaaagacttcttccttattatccgtctcagagtctgaagctgcctcttcggattctcccttcgtttctgtttctgtgttcgcttcctgcgtaccatcagactccaggtgatcttctatctcctgccttttctctttatccttattatattctgtatccgcagcagaaatcagcctggcatcctcattcttcttaatcatacgaaagcctgcaattacaattccaactacagaaaaaatgatgatcactgttagaatcatcaaacctatcgttccatatttcttttcgttacgtcccattattcagcctcctttgggcattagccatgtcctgtctgaatcgcttttgttaatattataaaagaatttccatttctatacaagcccaaacgtcaatagttaaaactaatttaatatcttacaaaatttaatacaatttttctgtcagtttatgcttgatattaatgagaatctagtatagaataatgaatacagaacataaagttcaattttatctaatctaaaggaggatactataatggcatatgtaatttctgacgattgtattagttgtggaacttgtgaaggtgaatgcccagcaggagcaatcagcgaaggtgatggaaaatacgaaatcgatgctgatacatgcatggattgcggttcttgtgcaggtgcttgcccagcaggtgctatcagccaggaataattcgttaattttacggcgaactattataagaggacatcgtgtttgcggtgtcttctttttttgtggtcaggcgccgctctaagccgacttgatgtaggtttctttattttgcgcggctgtctcaataaaaataaggcatcgttattctatgtctttcttttatattcggcaaatattaacaggggatttaggaggggttttctacgaacagaaaacaggaaaaggattttaccgcataaaagaactgattttgtgacttttgcgttgcggcgttctgactgtagcctcgcgggctcgtttttgagcgaggctgttttatcaggcagaacagagcgtttaacgcaagggaacaaaacagttcttttatgcggtaaaatccctttcctgttttcgtctgtttgtcaaatacccttccgtttattctttcggaagaaccgactctttttcttgaagattccatctttggaaactgcgatttcctgtcttgctttttgggtgcttcgtatggcttcatcgagttttttgtagcgttcttcttcccgctgttcctgttctaccattagctcgtccacttcgcggagcattttattgcaaagatggtttcccatagcatctccgaggttttctgcctgttcacggagggctttgcctacgattcgtcccatgatttcttcaaattgctgcattttttcttcgtgctcagcgagggcggatttttcattttggtggatggttacgactttgcagtttcggtcttcttttacagttccattgctgttggtactgttgtgatttctgtcagaatttctattgtttgtcctgccttttttgttgttgcctgaactattttcaaaagtatctctgtcattttcttcggaaaaatatactttggaatttctttgttgttcattttcttttccattctgtctctcttttccccgctgcatttcccgttctgtttgagaatccctttgctgctctgcttctttttgtgcttcttctaattcctgattttcaagttcttcctgtgttgtcagtagtttatgtatatcaatcagctttttttgttctaaatctggcagtacttcttttactgcttttagctgaaatcctttattctttaattctttaatacagtgtaatagctgtatttcctcttcgcggtaatagcggtgtcccaattcatttcttggtatgttgagttcgagttcttcttcccagtaacgaagaacatggttttccaccgatagaagcctggccgcttccgagatggtatatttgttttctttcataatataatccgctcctgttccacaaatattttaccggaatctcattgtaaatcacatgatgaatttacgtgcaaaatacactcaaacacagtattatgtaacaattcagaaacatacaaattctcaattgatatacgattgagcctaaatagttacagcattatgtgaatgcgtccggatggttacagtattattataacaactttaagaaaacagtctcaacgctattcgtattctaaattcttctcaattctttcaaataaagataaataacgacaaaattattcggattttatttatgaaaatagatgctggcaaaattatttgtatttcatttgagcaaaagcatatatcggtaaaacaaaaaagaaaagagcgagccactctacataacccgctctttgtttgcaaatttcgtgtattgtccgagccataccagctcgacgcttccggtcgcaccatttctttgtttggctacaataacttccgccagattctttttctctgaatccggattataatattcatctctgtacaggaacataacaacgtcggcatcctgctcgattgctcctgattctcgaaggtcagaaagcattggtttgtggtcctgtcttgcctcaaccgctcgggagagctgggagagtgcaatgatcggaacatctaattctctcgctaaaactttaagtgctcgggaaatttctgaaatttcctgctgtcttgattcgtttcgtcttgattcacttccactcataagctgaaggtaatcgattacaacaagctcaattccataagtttgtttgtactttcggcatttagaacgaatctctgccaaagtcgttgctgtatcatcaattataagcttggagttaccaatgagggccgctccttctaagagcttctcccagtcggaatctcttaaatcaccagtacgcatctgctgggaatctaccatagattctgatgccataagtcttgttacgagctgttcctttgacatctcgagactgaacatcgctacggcatgattatctttaaatgctgcatactgtgcaatgttaaggacgaatgctgtctttcccatcgctggtctggccgctactaatataagttctgccggatgcagtccggtaagcttgtaatcaagttcggtaaagccggtagcaactcctgtgactcttcccttggtctttgatgcttcttctatggcacttaaagaatttaaaacaatctgctgaatcggaacaaagtcggacatacggtttctgttttgaagaagcccgaaaatgtctttctctgtcttttcaagaattgtctctgtgtcttccttgccaagataacattcatttccaatgttctccgtcactttgatcaaagcgcggagtgttgccttatcgtgaacaatctttgcatactgtccgatattggccgccgttggtacaacttctactaaatcacggaaaaagtcaagactcattagttcttctggaacttctttttcttttaatttgttttgaagagtaatcaggtcaactgctttaccctcccggtaaagttctaccatagcctcaaatacgattccgtactggcgctggtaaaagtcctctttagtgaggatgtcttctgcctcaacgattgcgtctctgtccatcagcatagagcctaaaactgaacgttccgcctcctcactgtgaggctgtattctttttacaaaattctcgtctactgtcggcattgatgatcctttctagagcgtgagaggatgacagcgagaattgagattataatctcaattctcgcctgtcttctactttaatattacttttcagttacttttacttttaagtcagcagttaccttaggatgtaacttaatctttacattgtgtacgccaaggctcttgattggttcgtctacggagattttctttttgtcgagctcgtatccgagctgttctttggctgcggctgcgatttcttttgtggagattgctccaaatgtacgtccgccttcaccgactttcattttgagttctacactcttgtttttgagttcttctgcaagaactttggctgcggctaactgttctgctgccactttatcttcgtgtgctttctgaagctttaagtcattgatgtttttacttgtagcttctataccaagcttctttggaaggataaagtttcttgcgtatcctgcgttcacttctactaactgacctttttttccgagagactttacgtcttctaataaaataactttcattttaaatcctcctatatcgagtctgtttttaactcttttttataggtcatacaaaacttctttcatataactctatctttttaaatcactatttttactctatctttatcatactaatatctgatattctcttcagagtgtgttcctgcaaatatatttttaaaaatctatactccagcatcctctgattctaaataatcatatcaagtaggcagcagacgcaattcatctctcaccttagaggtcggagtcttcttgctgtaaggagataaataccgtctatatatccccatcttcatgcattttccgcaatgtatgttttaacatctctgccgcatcagaaagggatacgtcttttagctgtgctgctgccatcgtcagatgtccgccaccgccaaacttctccataattacctgtacattaagttcatcaatagagcgcgcgctgacatatatacaatcctgcaaagcagtcagcacaaagcttcctctgattccctgtatattcagcaatgcatttgccgctttggctccgacaacagtcgctccggagacattttccccatcaaaggttgaaatagcaaattcatccatgtaaatttctgctttattaataatcgctgttcgtatacggcaatgttccatatcttcacggaacatctttcttacacgagttacatctgctcctgctctccgcaggtaggctgccgcctcaaatgttctgacacccgctttgataacaaagttatctgtatccaccaaaatacctgaatacatggcatcagcctcaatattcttaagctttggtttatctacaatatactgtaaaatctccgctaccatctcacaagtcgatgatgcatacggctctacataagaaacaaccgcattcttaatcgtctcattactctgcctgtgatggtcaagaacaacaattgttgagatggacttcaataattccggacattctgtcattgccgggacattcacatccacaacaataagcattgccgacttatctttaagaagcattgcctcctcattcgttacaaaaatatcttcctcttcatctgcccgctcacggtaaatgccatctacgattggctcaattgccggacagtctttgtccataacaatatatgtgcttttgtttagtgccttcgacaggcggtatataccaagcgctgcgcctacacagtctgcatctggattcttatgtcccataacaaaaatcttatcatgtgtcagcataatctcccgaagtgcatgtgccttcactctggcttttactcttgtactcttttcgactttctgggtcttacctccataataggaaatggcatctccatctcttactacagcctgatcaccaccgcggccaagagcgagatccatcgctacccgtgcactctcataattctccgtgtagcttccgccattcacaccaacaccaatactcagtgtcatagatagctcgttaccgatattgataagccggacttcatcaagaatcgaaaacttagattccatcagctgttccagtttttcttcttcaaatacaaaaagaaacttgtccttctcaaatcccttaatgatcgcatcgagtccctgcatatacttcatgatctttcgctctactaaagcaagaagaagggactgtcttacttcctccatgttttcaagaacttcttcgtagttatcaatataaatcaatccagcaaccagactcttcttcctggactcttctttgtaaccaataagctgcgtctcatcaaaaaagtaaaatacctgaagaatatctccctgtgtctctttatcttcctgtatctctccctctgtctgttccaaattcttaaataccatatttcgacattccacatgatacttgtgctcctcatgtgtgatacagtactccttcatctgtccattctgagggaaaaccttcttataaagtcctggaaaaatctgtgtgatacttttctttgtgatcttctgtcctacaatctctgaaaactgttcattatgccagataatcgtaccatcctggtccgtcattacatacggtactggcagttctttaagaatctgcttctgaatctgactctgctcaaaaccagccgccagaaattccttgctaatcatcttctccgtatattcataacataaaacagccgcaatgagataaataacatctcctaccaagattgtatatccaagaccgggattcacttctatcacacctaaggccgctactaatataaagactaccacgataataggcaaccataaattcagagcgacccttcttgatatattcttttctcgtttcatttctttctcccaattaggaaatatacattgtctatttctctgagtttaaattattacagatatagtaaaaattattataacactgtttcccctaatttaaaaggaaaataatttgaaagcaaaaatccggcaggccagcgggcaactggtctgccggatgaaaactatggcaatagttatcaacaatattaattatttattctcatttcttgcctgaagagccatcttagcctgtaagtttctctggaactggtcaattaatacagccagaatgattacaagacctttgattaccttctgccagaactcggatacaccacacattgtcataccatcattgatgataccgattacgaatgcaccgattactgtaccaccgattgtaccaacaccacctgccatagatgtaccaccgagtacaacggctgcaatggcgttcatttcccaagtatcacctgtatttggatgagaagctgcaatctgtgccattgttacaaggccgatcaatgcggaacatgcaccggagattgcgtatacaagaataatgtttttctctactttgataccggaaagacgagctgccttttcgttaccaccaatagcaaggatatgccatccaaaaggagttttcttaagtacaaatgctgcgattactgcgaggataaggaagaggatcgctgcgattggaataccaggaaatccgccaactgcgaatacacggctatcaaactgcatgatacctacgtttccgagtgcttcctgacctttgatacttgagaatgtatttccgccggaacggatatttgcaagaccacggccgatgtacattgtacctaatgttacgataaaaggtgctaatttacattttgcgattaatgcaccgttaacaataccgatgataataccgataatgatacagattactgtgatagctggaacgctgaagtaaagtgtaactccggcaaattttaaagtaagaccttcctggataagaccaccggcgatcattccgactaaacctactacggaaccaacggaaaggtcgataccgccggtaatgataacgtaggtcataccaataccaagaataccatactgtgcaacgtgcttacatactaaaagtaatgagttaactgtgcagaaagaatcggctttaatagagaagaatataaataaaattatgagtacgaataatgttcttccctttaaaagtgtcatcataagattcgaattatcttttttcttattcattttgatttctccttttccttgttatgtacttcggaagacttttccggcttctgttaagctggcatagaaaaattccaaaatacattattagttttagtgatgacctttgtaggatgctaataccagattatcctctgtgatctcgtcatctgtaaattctgcggtcttaataccgtttgataaaacgacaactcggttggcgattgccagcatctccttaagctctgaacttacacagataatggaaagtccacggtctgcatactggttgataatatcaaatacctctgtcttggcaccgatatcaataccacggctcggctcatccataagaagaatcttaggatctgtcaacacacctttaccgattacacatttctgctggttaccaccggaaagggataaaatcggaagatgtttatctgctactttaatatgaatatctttaatctgtgcatctacatattcgtcttccttttgtttggataaaacgaacttattacagcaggtctttaagctggaaagggaaatattcttttcgatatccagtgtctgtacaagaccttctgcctggcggtcttcaggaactaaggcaaaaccattcttgatctgctctgcaatgttcttaatcttaattttcttgccgtcaacataaacctctccagtgtgttctggatgaagtcccatcagacattcaaatacttctgtacgtccggctcccattaagccgtaaattccgagaatctctcctcgttttaacttaaagcttacatgatcaagcagccatccgccacctttctttggaagacagaggtctttaacttcaagaacagtatcctgtttctcccagtcaatatctctttctttcttagggtaggatttgttactacctgtcatcttctgtacgatccaaggaacgtcaatatctttaactgctgcatcatctacatatttaccatctcgaagaatagtaacatggtcaccaatctccataatctcttcaagacgatgggaaatatatacgatggaaatgccctgggcatttaactcacgcatgatcttgaaaagtacctgtacctctgactgacttaaggaagatgtaggctcatccatgatgagaatctttaagtcatcctgaattaagttacgggcaatctcgatcatctgctgctgacctacacgaaggtctccgactttcgcctccggatcaatcggatactccagtctttcaagaacctctttggtcttctgtttatgtatttcattatttacaacgacaccttttttctgttcgttgttcataaaaatgttctggtatacgtttaagttgggaaaaagggaaagttcctgatgaatgatacctactccctttgctctcgcctctgttgtatttttgaagcttacttcttcgccgtcaagatacatctttcctgaagaaggctgctcgattccggcaatctgcttcattaatgtggacttgcctgcaccattttctccgattaatacgttaacttttccacggtaaatgttaaagtcaacatcgtcaagagcctttgtaccaggataaaccttttccatgtgccggcatttcattacgatatctttatctttattctcagccatccaattcatcctcctctaactgattcttactgtgttctgtctgttattttacttcaagaacaaccggagtaattacgattgcatcattggaatcagcagtgaaacatccaacaaggtttactgttgctccttctgcaaggtcatcgtatacaggttttacaactgcttcttcaactttttcaagcatacttgtatttacctgaccccattctgtctggtttgtaaaatcagagaagttaatgaaactcatatcatcacgaatagatgaattcttatatttaccaatctgacaggtaactactgtctttcctgtgtagccaggaacttctaatgttactgttccgtagaaagaatctttatctacttttgtaatctttgcaccttctaattttactgcatagttataataagaagctgcttttgtctttaagccatcaaattcttcgcccatttctgtgagcttgccatcatactttgctaaaatgtcagatacatctactgcttttttctcacattctggaattacttctgaatcccagattgcttctacactgtcaccaggattgaactctttctgccctgtaagatctccctcatgaccaatctttactaccttcacacagcctgttaataaaacggctgccattactactgttaaaacagtacttatcaaacgttttgccatggttttcttcctttctctattccctgctgtccctacatgtgagaagggtgccgaataacttattggcacccctccacacactgaagagagcctaacccccttcagacctaacagattcaattaaatttatactacgaacttctcttattctgcgaaaacaaagttatctaacttgtcagcgttatcctttgtaattacaacacagtcaactaactgcttctcttcaagacctgtagttccgtttgtcaggtaatcgttagcctgagtaactgcatttcttgtgatcttatcaatctgctgaagagctgttgcaagtgctttaccatctttgatgttatctctcatatcgttagatccgtcaacaccgatgatatatacgtcatggtcaaggtttgctgctgcaactgctgctgctgcaccacaagccatagtatcattaccacaaacgatcgctgtaatgtctggatactgctgtaagattgtttcagctttggactggccttctgtctgatcccagttagcggactgctgagcaaccatcttcatgtctgtctggtcaagaactctgtggaaagcgttagaacgaacctggcagtttgtatcggactcaagtcctaataattctgcgtagtcaccttttccgcctgtagcttctactaatgcttctgctgctgcctgagcaccctggtcattgttagctacgatctgagatacgcaaagaccttctttgttgatctcacggtcaaccatgaatgtagggattccagcatcataagctttctgaactgcttcgatagaagcatctgctccggcgttatcacaaacgattgcggatgcgccttcggaaatagctgtatcgaataattcggactgttttgtagcatcatcatcatgagatacacatttaactttgtatcctaacttctcgccttcttctttacatgctgtctgaacagtaccgaagtaaggattagaagtagatggtgtgatacagtagatcagcttgttagctgcgttagtgttaagaacttttgcaggagctgctgcttctgttgtagcctctgctgctgccttatctgatccactatcttttgtactactattgctgcttccacatccagccattgtagctaccattgctgctgcaacgaagccagctaaaactttcttaaacattctcatttttcatttcctcctcattttgaaaaatatatgctagataacacagaagctgttagcccttctgcgcaaatctcaaggatgttttgcgataatacaagtgtactccaatttctttgtgaaatcaatactattttattaaaaagtcttgtatttttttgtttactttgctatgaatttaacatagtattgggaattcccctatactattttgttaatacgagtccaacactctctttccagcctgtatattttgtgcatcttgtctccgcatccatctcaggggtaaatctggtgcggttaagactttcaaataatgcagtctgttcgtaaattcccatagcgattccagcggcatatgccgggcccatagcagataattcctctgcatctggtacctgtaccggaatatctaaaatatcactctggaactgcataagataaccattcttagttgggccgccatctacgcgaagctcatcaaccttgatgccagaatcttctgccattgcattaactacatcgctgatctgataaacgatacagtcaagtgctgctcttaccagctctgccttacctgttgtgcgggtgattccgctgacaacagctttcgctttactgtcccagtaaggggcgccgagacctgtaaatgctggtacaagataggtagtatctcccggattggcactcttagccagttcttctgtttcctttgcggaggcaatcagtccgaggtctttttgcagccatgtgataactgctccggtgtaattaatatttccttcaagaacataattcactttaccggaaagagaccatgcaagggaagtaacaactcccttgtcactgaaaataggcttctcaccaacgttcatcataatagaagaacctgttccataagttgctttaatcattcctggattcacacatccctgtccatataaggctccgtgggaatctcccatcacaccatgaatcggaatggcttcctcaagatatccatcaaaatctgtatagccatataaggcattggaatcacagatttctgctaacatttcttttttaattccaaataaggaaattaattcttcatcccagtcaagggcagacacattaaacatctgtgtccgggaggcgtttgaatagtctgttttaaacgcatggtcttttgtaagctggtatacgaggtaactgtccatcgttcctactgcaagttctcccttatctgctgcctcttttgcttctggtacgttctgaagtacccatgcgatctttgctgcagaataatatggagacagcggaattccggaatgttcctgtaccatctgtgcgtaaccgtcctctgcaatcttgttacagattgcttcaccacgggcacactgccatacaattgcgttgtaaaccggtctgccagtatttttgttccagcatactgcggtctcacgctgattactgatacccagggtaagaatctcttctttatcaatgcccgccttctccacaacattctttacgacctggataacatttttcataatctgatccgggttatgttctacccagcccttttcgttgataatctgatcatgtgcaaggtcggttcgggcaataatcttacctgaaccgtcaaaaatgataccttttgttccctgcgtactctgatcaatacccaatacgtatttcttcataattatgctaaagcctcttttgcttttgctgcaatgccttcgccgttcattccgtagtaatcaaatactgctttggaattaccagtgattactggtgcatctggcagtgctacgttaactactttcttagggcagtttgcgccaacaacctgtgctaccatggagccaagtccgccaaatggagcatgttcttctgctgttacaactgctttggcgtttgtagctgccttgatgattgcttctgtatctaaaggttttacgcagtacatatcaagaactgttgcgctgattccctctttctcaaggatttccgctgcttctacgcaaggtcttaccatctcgccgcagccaattaatacaacgtctgtaccttctttaatcacagtagctttgtccatctcaaatgggcagttgtcttcagagtaaatatcttctaccgggttacgtcctgtacggatgtaagctggtttttcatcttttaataacgcttcgatgaggtgttttgtctgaaatctgtcacttggcagatacactctcatgttaggaattgcgctcattgctgcaatgtcctgtgcggaatgatggctcattccaagttcaccgtagctgataccaccactgataccaactaacttaacgtttgtgttagagtaagcaacgtcaacttttgcctgctcgtaacttcttgtagaaatgaaacttgccggggagaagcagaaaggcttcttgccgcattttgccataccagcagaaatacttactaagttctgctctgcaataccgatttctacactattttcaggataagcattgaaaaatggtgtcatggatgctgaaccacgagagtcactacataaagcaacaatgctcttatcctcttttacctgttccattaatgtctcacagattacctgacggtttgcaatcttattcatttgctgcgtccctcctctttaaaagttcagcggaaattgtctcgtacatttcctgtgtaggtactttgtggtgccagtcagctttgttttccatgatctcgccaccgccgtaacctttaattgtatctgcgataattaccgttggttttcctttgcaggtctttgcttcttcaaatgcttcatttaaagattcgatgttgttaccctgtgcatgaatggaattccatccaaatgcgcggaaacgtgcatctaagtcatcatcagccataacatcttctgtgttaccggaaatctgaagacggtttctgtcaactactgcacaaaggttgtctaatttgtaatgtccggctgccatagcaccttcccatacagaaccttctgccagctcgccgtcacccataactgtgtaaacacggcctgtctttccatccatcttatttgcaagtgccataccaacacaaactggaagtccatgtccaagagaaccggagttcatctcgattcctggaagtttgttatttggatgtccgatgtatggagaaccaaatttggagaagttcttaattacatcttcgatatctaggaagccttttgctgcaagaacagcatagtatgcttctacagaatgtcctttactcataacgaataaatccctgtcaggatcgtcaagattatcaggactaatattcatctgtttaaagtacagagtaatgaggatatccattacactgaagtctccaccgatatgaccggctcttccttccatgatcatatcaaggacattttgtctgcattcaaaggataatgcttctaaattcacttttatgcctcctatataaatgtaaataaatgcgataactattcagagttcatcttttatgctcttttgcaaataagtttgcttcgctatatattttttatatatttttcatgtaaacatcattcaaaaattatccgaatctgaatagttatcaaattacaattgttaacttaaactactaattatttttctaccttttcaccgcggatgatagcttttactttttcctcgattgggtcatataagtctggtgtaacaccgatgtacttacatgcttcgtataatacaggtacaacatcctgatgaacacctacgcagtggtggatgtaaggtccctgaacgagtttatcttctaagcggtcaaggttctcaacttcaacccacatataggtaccttttgtataaggaccatctactgtcttagcgtttccaagaagtaaggagtattctccgttatctccgtcaaaacgtactaaggaaatgtgttctccgtcttttgcctgtgccattaaggaaccagaacaatcgaatgcaactggtgtgtcgatcgttggtttttctttggcgatggagattggccatggaccacagtgctgtaaaagctctgcgttgtcattatatggatgacgaactgtccagtcagcgaagaaagatcttgtctctcccattgctgcagcctctactaatacagaagtgattgttccgtggatatctgtctcgcatgcgattgggaatccctcatcattgcaaagtgcatttgctgcacatggcatgattccgatttcatcctgaagtgcgttccagcactgaatcgctccacagttacatccgtatttctttcctaatcttgtcatagcaatctttaatgctgctacgttatcaagctgttctggtgtaactttgatgcacattttctcacggcagtaatctgttacttctttaatctcttctggagaattctcctttacatctttcattgcctgagttaattctggcattgggattggggaaagctgaattccaaacttctcaagtaattcgccttcgttgcacattgttgaccagaaatcaaatggtcttgtggaaatctgaagaactcttgtgttacggaacgcttttactacgttacaaactcttaagaaacggtcaattccttctgcgaagcactcatcttcaaggttgcagttctttaaatatgtaaatggaattccgaatcttcttaaaactttacctgttgcaaataatccacactggctgtcacgaagacgcataccgttctcatctggacattcgtctcttggtccccataataaaacaggaacatttaacttcttagccaggcggcatacttcgtattctgtaccgaagttacagtgaggaacgaataaaccatctacttttgcatctctaaacttttcgtagattttttccattccagcgtcatcatagagaagaccttcatcatttacatcgtcaatatctacgaaatctacatttaactcttttaatctctttgctgttaatcctcgatatactacagctgctggtgctgaaaaaattgctcttcttgttggtgcaaaaccaagtactaccttatccatcctctaatttcctccttcttttgaggcggagtttaaatcaattacgctgtcgcgctctacaaactccgtacatacctgtgtctttgtatttattttaccgccgtccttcatgacttctatcaatcgtctgactgcaatctggcccatctcgtatttaaatactttgatcgtcgtcagtcgcggtgaagaaatctcgcagaacggaagatcatcaaatgaagcgaccgaaatatcttccggtactctgtatcctgcttcctgaaaagccttgatacatccaagagctatcatgtcatcatctgcaaaaaatgcggtcggcatcttcgctccctttgccagatattccttcatatctttgtaagccccatccatcgtggtactcactgtgaaaatatactggctgtttaactcaatgttattcttggaaagtgctctgctgtatcccgcacaccgggaagtaaatgccttgattcgaaatcttcctctgagatatcctatttctctgtgtcccttattaataaggtactgaactgccgtcaccgcagaatctgcattattaataagtacggcattcacagagtaattcgaactccagcaatccaacagcaccatcggacaatttccactcatatatagaggaaagtcctcatccatcatctctgttccaagcaaaagtatcgcagaagaggtatcattcagaatcagctttacctgttcctcataatctggatcgttacggtctacattacatataaccatctcatatccagaaacccggcactcattctctacacccttcaataaaataggaaagaacggggaatcatcaataatcaacccatttctcttgtagataaccagttttatttttgtaattttattctctgagatatatccaatctccttcgctacctgaaagattctttctgcggtcttctgattcacaccttttttgtgattcagcgcattcgaaatggtcgccggagaaaagcctgtaatctcactaatctgttttatactggctttcatgtctcactcctccttgctgtgttcattataaaatttttacataactttttcaataactttttgttaaaaagaagtagaaaaaatcaaatatgtgaaatataactatatgtagaatgcatattttatgcaacttcacaatgatttttgcatcttttttccaatttcattctttttaaacattttgacatctaaatatttatataaatattttatatgaacatttagatgctgtttttctgaaaattttagggttttatttaactgaaggaattggcaggtttggcaaataaacagacgaaccaacaaacccttataagcagaagacttctaccctctccctcaaattcccagcacaaatgacaatttgcaccttcccagccaaagtcagcctccaaagagaggatagcccctatatttgtggcctcgaagcaaggtttgaatgtaagcgcgtgaagcgaacattcaaaccgccgcgactaaagtcacaaatataggggttatcctctcttcggaggcgtctcttttcctttgacaaattccattcatcaatcattgcgatttttgtcaaaattcagtataatatttatcagtactacttagtttaagggaggttcgtatgaacgataaattttcacttttaaaaagaatgcgccgtctttccggtatcttagttcacccaacttctttaccaggaaagtttggtattggagacttaggcccagaagcataccgtttcgtagatttcttacaggaatccggccagcatttatggcagactcttccgcttggacctactggcggacataacagtccttatcagtgcttttcctcttttgcaggacagccattgttaatcagccctgaacttctgaaagatgaaggacttctcacagacgctgatttaagtaatgttcctcacttttcagacgaggaagtagatttcgctgctgtaggagaatataaagaagaactctttaagaaagcatttgcccgctttaaagaacttccagaggataatccgttaaaatctgagcttgcactgttttgtaagagcgcacactggcttgatgattatgcaatgtttatggcaatcaagaagtccaaaggcggcgctcactggttagagtgggagaagaaataccgtaaacctacaaagtcccagaaagctgttattgagcgtgagtttgaagatgagattctttatgagaagtttcttcagtggacattttgccgtcagtggagccagttaaaggcctacgctaacgagcgagatattcttttaatcggagatattcctatctttgtttccggcgatagtgctgatgtatgggctgagccaagactgttccaggtagattccgatggatttcctactgttgtagccggagtaccaccagactatttcagcgcaacaggtcagttatggggcaatcctctttatgactggaaataccacaaaaagactaattacgaatggtggatggaacgtttcaaaacacagttcttattaagcgacatcgtccgcattgatcatttccgtggtttagaaagttactgggagattcctgccgactctgaaactgctttaaatggtaaatgggttgacggaccaaaggatgaattctttgaagtattaattaagacttttggagaagaacctccaattatcgcagaagatcttggtatcattaccgatgatgtacgcgcattacgcgacaagtttggattaccaggcatgaagattcttcagtttgcatttgaggacgaagacagcaattatcttccttataatcagccatataactgcgtatgctatacaggaactcacgacaacgacacaactacaggctggtatgcaaccgcatctgagaaagcccgcgataaagtacgccgctacatgaatacagacgcttcgcaggttagctgggacttcatccgcacctgtttcggttctcctgcacgttttgcgatcattcctgttcaggatttattctgccagggaagtgactgtcgcatgaatacaccaggaaaagcagacggcaactgggcttaccgcatgaagaaggaacttcttacaagcgatgttgcaaaacgcctttatgatgtgacaaaactttacggacgctagagtgtgtttgaaagggggaaattatgacttttcgttctatctgcattgcagtttatgtatttttctatttaatatttacgaccccaatgcgggctcgtttaaaaaagctggagaagacggatccacaggaagcttctcgcattgcacaggagcaagttcagaaagtatttaagcatcttttgaaaatatccggtgttaccatagaggtaaatggactggaaaatatcccggatgaagcttcactctttgtcggaaaccacagcagttactttgacatcatcgttacaggtgctactattcccggcggtgtaggcttcgttgcaaaagacagtctcggaaagattcccggactttcttcctggatgaagtgcatccactgtctgttcttagaccgcagcgatgtgcgtaaaggattacagacaattcttgaaggtgtagactatttaaaagaagggtactccatgtgcatctatccagaaggcacaagaagtacaaccggcgaacttggagaattcaagggcggcagcctgaaaatggcacaaagagccaaagcacctgttgttcctgttgccatcaccggcacacgcgacatctttgaaaataatccgggacttcgtgtttatccttcgcatgtaacaatttcttttggcaagccattcaagttttctgaccttcctgcggctgagaagaaatttgctggcgagtatgttaagaaagctattgaggatatgctggcagctcaacagtaacaaatcacatccagattattatattaatctggatgcaatactaaaaaaacgatcaaagattatgcttacccagtagtaaccagctttaaaaagcttatttatacgaaaaagtagcataaaaccgtaattttttcttttcaattaacgtaaataatgttagaatgaaatttgtgttatcaaaaaaagaaagaataggaggaatattatgaacccatggattgtttttgcaattatccttttagttgcactcgccattctcggattcctttattacaaaggttccaagcttcagaaagaacaacaagaacaaaaagaacagttatttagcgccgctactccggttactatgctggtaatagataaaaagagactccctttaaaagattccggtcttccacagattgtaattgaccagactccaaagagagcccgccgcgcaaaagtacctgtagtaaaggctaagatcggacctaaggttacaagccttatcgctgatgaaaatgtatacgatttaattccagtaaaagctgagattaaagcaatgatcagcggtatctacatcacaagtatcaataacttccgtaaagctccggttccaaaaccagagaaaaagggaatgatggctaagcttcgtaagaaggcagatgatatgactactaaataagtttgtttttgtgtgaacagacagacgaacctaaaaagaagcccttattataagggcttcttttttagtttctgtttgttggggcaaaaatcaaattgctaatggagcaggcaaaataagcttggcggttcttcaaaagtcaagttactaataaagtagatgaaatcattttgaacccatccttatttttctgaatatctcgtactgtcgctgtagctctgcttcttcatcaagtaataatccttttgcttctaatattctttcaatagcctgagatgggtctaatgtatgatatggcaaaaataattcccgtaattctttaggttttatgattttataaactcgtgctgatgtgaattcgtaggtaattgcaaaatatctatagatgtatccaatccagtacatctcattatgagtatattttaccgttccataatgtgaaactccatattcctcatccactaactgtaaaatatcatttgcctgaagattactttcaaggattgattcgtcatccattcttttggctatattacttttcataaatcttctaataaaaatctcagaacttgaatccattttatctatagaattttcaaaggctgttgcctgaagttcacataaaagcaaaccatccctatctatctttttcatacattatccacttccttacaccaaaatttcatcaatgtaccggcctttgcccctatattgctttctggccaattttactttattagctcctaacttcgactcttcaagtcgtatattcttatagtattttctttcattttgcgaaatataacaacgttctataagttttgcctgcgatactgctttttcgcttacaaagatatactgcattccaagatttgttgctgcaaggcagtgtttacattgttcatctgtaagttctccttcaataaatgaattaatgatttgaaacatacgattatctgctattggtgcaattatgtaatcacaagctctcgactgttctatattttttttaataactggatgattcttatactcatctaacgcacctctatagtacgcaattgtcatcatccactcttgatttacttcatatcttttacatgtaagatcatcatcattaaaacaaatataatataccgatgaattctcaaatcctgaaacaaacgatattgcctgttcataactttctcctgcataaaaaccctgaccaaaatcattattatgtctgcctctgtgaatatctatcttcccatcaattttacttttagctccgtgaaaaagtaatttctcatgtttttttaaatcatctctccaaaacatttcctttaatttattaatctttatatttttagcaaaagcaaatgtatataagttcaacataaacttatttataacacattacttaaataagttttgatacaacactactcaatccaccctcctctctagagcgtgtttgaaaaatgctttctgcaagatgtacatcacaatttgcgggagatttcgcctgaatgagggcggcgtagcgggctacggcaaccgaatgaaggcaaaataaaccgtaaattggggtgtgtagcttgctggaatgatttttcaaacacgctctaaccataatgcactctcggaatctttttttgggtaaagatgacgttcccaaagagggaagatagccgatttatggggttcagcggcccgtctgtttatcatctcaacccagtataatcaagaaagaaacaagtacaactcaccatttccgctccctcattccgataaatatgtgcctgatctgtctcaaatttatagacctgatctttattaatcgtctgcgtatgtccatgacattctatcgtaagtacaccttctgttactgtaatgtactctcttgttttttctccatgactcccactcatatagaccccaccgggttctatgtcaatccgatatacttctacggaatgagaatcttcataaggaaaacacgtccagactttatattgcccttccagttcttttgtaggaaaaatttcttttggacttacaaggcaaaagtcttctcttggaggatcaataagtgtctgaaattctatacggagaccgcttgtaatctttccaagtacgccaagagagggattagctgtacctttttcaatctgagcgagcatacttttactgactccagtctgctccgcaacctcgccaaggctcattccctttgacaggcgaatctgttttaaattaaccgccacattatgagataaataatccatgaaactcctcctttgtgtgatttaatttattggggaatgtaggctaacagacgaaccatgagaatacaatattctttatctgtgactttagtcactgcgagaaaaagtcttctatgaaaagcctctcatgaaaagttattgattttaactccgttgcaaaaaacacaaagtcgcaaaatcaataacttttcatgagaacttttctaacataagtttactcactcgcagctccgaggccacagataaagaatattttgatattttctaagtaatgtagaaaatatcaatccaaatttccaaattgccctttaataaatcgaaatcactaattaatattaccataatatcaaaacaatcagaagcctacaacccaaatccacattaagcttctagttatcgaaggcaaaaatcatatcaccatacttgagcaaccacaacaaggctaactgctcacaactcaaatcctcgcagggcttctatttatcaaagacagaaaccgggagaatcgtatactagcatctgtggcctcggagcaaggtttggatacgagcggggaagcgagcattcaaaccgccgcgactaaagccacagatgctagtatacgattctcccggtttcgtctgttgttactctcaaatagaagccagcaccctgtcaattgctgcgtcaataactttatcaagttctttatcgtctgcttctggcataagtgttgctgcgtcttcatcagaaataagttcaacaagatcaccgaaggattctttgtattttctcttacatacaacataaaatactacaccgagtaaactccaggctcctaccattccccattcaggaaggatcaggcttccgccgctgcccgggatacagtacatacataccatgaatccggacatgatgactgccattgttccgaagaatttataagctggaactttatatggtcttggcatatcgggttctttttttcttaatatcataaaggaaaccgctaccatacagtaagcaagacagcatgcgaagttacctgcatcagaaatccatacaagaagctgtcttccggcaaatggagcaagcattgtaaggacaccaataagaataagtgcattaattggcgttttatgttttggatgaagttttgcaaatgtttttggaatcatataggattctgccatggaatacattgcacgagaaccaccaattaagaaggagttccaggatgtgataataccgcacataccaccgacaataactacttttgccatgattttcattccaaatgctgttcccattgcatcggctgtaacaagtccggttgcttcctgtgattttatgatcgcacctgagtcaagaacaagtcctacggcgataattacaagtgcatagaaaacaacggctaaaattacagataaaataagcattttaccgattttctttggaggaacattaatttcttctgctgcctgtggaataacgtcaaaaccaataaaataaaatggtgacattgctgcaacaccgagaattgctttgatattaagtcctgcggtgtttccgacaaacatctgtccatctaaattatccacagtaccattaattacggaagctacaatcaataaaattcctgcaccaccgatgatacaggtaagtaccgtctgtaaaatagcggctgttttcgctcccataatgttaatcagcataatcaaaaatgcgactataattgcaactgcaagccatgaagcatatacatcaaatcctgcaacagtatacagatacccttttaaaaatcccggccacaggtaagtgatgattgttggaaatgcacaagcttcaaaacacgctacactgacatatcctaaaacgattgcccaggtacagataaaagaacctgtcggacccattgcacgatgactgaatacgtgttctccaccacactgtggcattgcagctgtcagctctgcgtaagtcaggcctacgaagaaaatcataacgccgccaaggcaaaatccaagtgccgctccaagaacgccgcccttttcaatccagtttccggttgatacaacccagccccatccaatcatagctccaaaggcgattacgaggatatcccaggcactaaatactttgttaaattccgattctttcttgttcatatcctgtccctcctattcgtgaaatactttctttgctacttcttcaatgagttctgcagttccgtcaacgcctaaaagactgctgtcgatcagcatatctctgttatgacggtcaccacggttacttcctgtcagagcaagatgtctcttatgataacgtttatctttttctgtaataaataactttgcatcctcggcagaaaagttatggctcttcataacattttcaattcgaacatcttccggggaataaataaagattcgcagtattggtttctgctcttttaaaatgtaatcagcagaacgtccgataattacacaggattctctgtctgcaagtttacggataattgttttctggacgtgaatcgcgcgctgcgttaaatccgcatatttggagaaagaacctcgaacatcaccttctgcaccttttccggcgattgttccaccttcttctaccttttccatgatgtctttaggaataccaacttccttgataatcttatcaaccgtatcacggtcataaaactttattcccaaatcctttgcaacttttcttccgatcatgttgcctttcgcgccatattcgcatcctatcgtaataacaagatgtgccatatttttttcctttctaacttctataatcttttaatataaatgtcggctataatgctcactttataaaaatgtcatctttaaaaatttgtaactattcagaattcattcgccaaatatatctgcgacgtttctatctctgtctgctttttctgttctttcaactagaaaaagaaaagggcatcacaaactcacttgtgacacccttgcctaataacgtcttaacataatgcttttacagcttcttcaataatcgcacaagcctcatcgcactgttcttctgtaacaatcagtggtggaatcatacgaatgacatgtgccccgattgctgtgataagaagctttctgtcaaggcatccatgttttacttccacaccggaaatctcatcatcaaattctacaccaacgaggagtccctgatgtcttacttcttttacatgtggaagtttctctaattttgctgcgaaataatctccaactttctttgcatttcctgctaagtctttgtcaagaagttcttctacttctgccaaagctgctgcacaactgattggatgtccaccaaaagttgttccatgagaacctggggtaaatgctttagatacttcttctgttgcacagatagcaccgattggcattccgccgccaagaccttttgccatagaaacgatatctggttttactccataattcatataagacattactgctccggttctgcaccatccagtctgtacctcatctaacaataagagcattcccttttcatcacagaattctctaagtccttttaagaactctggtgttgcaggatgaacaccaccttcgccctgtaccggctcaaccatgatagcgattgtattctcagtacatgcattcttaaatgcttctaaatcattatatggcgcataggagaaaccataagtcatcggaccaaaaccaacctggcatccattacccggctgacctgttgcggacatggcaccaaatgttcttccgtggaatcccatcttagcagttacgatatgatatttattagggccgtatttttcaataccatatttacgagccatcttaatcatcgcttcgttcgcttctgtaccggagttctgataaaagattttatccattccaagagtcttacaaaccttttcagcaagtaatgcctgtggaattgtgtaaggataattaaatgtatgcatgatatcgtctacctgatccttaactgctgcaacaacctttggatttctgttaccagcgttatttacagcgatacctgcataaaaatcaagatatggtgtaccattctcatcgtaaatatacattccctctgctgtctcagctaagaaatcaaaacgctcgtaagtctcgatcatatatttatttactttgtccttaatatcctgtactgtaagtcctgtatcttttaatttcatgataaaatcctccttattatctaaaactttcattttctttttacaaaccggtttttatcatatgggaaatgacatcttccccatgaaacaaaaaaagcaaagacacttacaaattgttgtaagcacctttgctttaactgtctattattttgtacgcttatacaatatcacgtctctcttaatctgtcaacaggtaatttaaaaagattttttgtagatttcagactctaaattcgaatgtttttggtttttccattgcattttgtctattatattgttcatacaatttgacagacaatcccagaattactacaaagcctttctatatatctcagcgatttcttcctgcgtaaataccactggattgtttgctacgcctgcggcggatactttcatgcagttttccgccatccacggaatatcctcctctgcgatgccgaggtcggacagtttgcattctaaatcaatggcttttaagagttcacggattttatctgcacagtcagctgcggattttccgccaaagattttcgcgatgtttccgaatttttcttcgtctcctttataggatgcatcaatgactactggtgttaaggctgcaagtccctggccgtgtacgatgtttttcagtccgctggctggatgttccattccatgtgcgagggttactctggctgtgttgattaccataccgccgattgtacttgccattgtgatattttcccactcttttttgtttccagttccgttgtatacagaaacaaggttattcgcaatgagttcaatagcgtataagctcagtgcatctgtgagtggctgtgcgattttggatgtgtatgcttcaatattatggcataatgcgtcaaatgtaacggatgcgagtacttttttcggcattgtcatcatacattccgggtctacgatggacactttggctacgatggcattacagcggagagactttttatccccgttatcaggattggtgagaacagcaaatccatttccttctgaaccggtaccgcaggttgtagggatgagcactaatggcagggcgttatcgctacgcaggcgattatagatgtaatcgttgatatccccatcatttttacttaaaaatgcaatcgcttttgcacagtccatgatacttccaccaccgatggcaacgacaacatcacagccatttgcctttgcaaaatctgcgccttcctgcgctgttgttgtgagtggattctggcttactttgtcaaaaagagctgtttctaaacctgctgcttttaagctgtcgtttaccttatcataaagtccagacttttttgcactgctttttccagtaacaatcaatgcttttttaccataaggtctggtcagttcccctgtctctaaaacttttccagaaccaaatacaatgtttaccggcagaaaataattaaattccatgatgcttccctctttctttactttgcaaatattatgtttctaaaatatatttaacaccagcttttattttttgccagtatttttttactcatttcttctatctaaaatagcctttgcctttgctcctggtacacttcctgtaactatttttggtaatgcttctcttaacatatcgaatttctccttaattctaaaagaaaaaggtgtaatcccagcgtttgctgttattgcacctttgcttgtttcctatttatttttgttacttatttatttcatggcattactataacacaattctttgatattgccatcgtcacaatacacaaggttgttgtgcagcattcataattgctgtttcattcaaggcaaaagcagaaggacagacgcccgagaagagagcctatgccctatatttgtgactttcgtcgcggcggtttgaatgctcgcttgcgcgctcccattcaaaccttgctcccaggccacaaatataggggcaaggttctcttctcgggctgtctttggctggattttgtttgaattagacaggaagggatgagatgctgcggggaggatgatttgaggatgaaagttgagggctttgatttgattcaggccagctactgtcagccctcaaatcaatcccaaaaattcatcaatctgatatgccatataccagtcgcttctatctttcgtggagttgagtgttttacccgtgatttcagcgatttttttcagatgataggagacagtatttctatgcagatagcattcggttgcgacttccccgatatttccgttagtttcgaggtagcattttaaaatacggatgtattcgctgccggtttcctgatcgaatcgctctaattcgccaagcattttttctcgatacttttccagttttttgatattgccgattgagagccagagtctgcttatgccgagttcttcttcctgacagatatttttgcctttttgtcttccccagcgacataaataggataagtctctgtatttttcccacaggttttctaccacagtttcttcgtcaccgactgccatgtaaagttctttttgccgggcaaagctttctgaaaatgtttttatctgttggattacattttccctttctgtgcctgtaggcatttttgctacgagtgtgatatacaaatctcgctgaaaaatgacggagagtacctttttctcagcaaatatttgctggcactgccggataaagcggtagaagaactgggtattgtcgaatttatcgtctgcctgtatatctttattggctgggaaatagcactgaatcatgaagaattctgtgtctttatggatatgattctcatgcaagacaggcatatactgttgttcttctttacgggaaaagattgctttctggagtgcagtttccaatccgtcctgctcctgcatcgttttatagatcaggttacataaatctctgttaaagtctacgagatggacttcccacggtaatgtaaaaacagggaatcctgcttcttcactgtatgcaataacgcccctcggtactctggtgatgtattttccaatattaataaccagaccgcttgcgcctgtttcatgcaggctttttacaaatcggacgagtgtctcttcgtccttttccctgattccagttgtgataataagctctctgccttttaaaaaagagacataatccatctcctcgacggtatgtacccagtcaacgagatttcttaagcctcttcctccggcaaccagcttcatattgtaacggtgtaatgccacctcatagatttcttccaatattatcgccattgttacctcttttttagtttcttctataagtcatttcacaaaatactgccagacaaataatgatacatagattagtaattcacgtcttggaatattaaatgctttgcagtatttatagtattgccatagttcttcttcctactccataaacttcgccagcaccgtcaaatcataatctgataccaacattccattcatgataagagaatatttaagctgtaatttaaaatgtgcatctccgtgtaatacacggattttcttcgtgtcggacaccagttccatcgggcctgccggggactgatagaggcagttcttgttatgctctgtgtcaaatacgagtacagagttgaagttgcccgctccagttttgcggagttctacgttacccggagagatggtgaggcggtttttaatgaccgccccttcttctgtccgctctgaataaaaaatgtaatgcacaccatttttatgaatataacttccttcggtaaccagagtgacgggttcttcctgatcgaaccctttctggatacctgttatcgtaagccagacctttcttgccataactttacacgtcgtatctgttcattgcaagatcgataagtttctggacaagagcctttttgcttaaacctcttgcttcccagagcattggatacatactgatagctgtaaagcctggaagtgtattgatttcgttaaatacaacctcgtttgtatcttttgtcaggaagaagtctactcttgataatccggagcagtctaatgctttaaagattgctacggcatctttgcggatttcttctgcttttccttctggaagttcaggatctacgaccgttctggattcttcgttgttgtacttcgcatcgtagctgtagaattcttcagcagataatacttcgccaacaccagaagccttaggctcattcattccaagaacaccacactcaatctcacgacctacgattgtctcttccactaaaatcttagaatcgtgttttgctgcaagattcagtgcatcaatcagttcctctctgttctctgccttgctgacaccctgagaagaaccagctttagaaggctttacgaatacaggatatggaacacctgcttctactcttgccactacttcatccatgtgtgtaagttcatgtcttcttacgccaacaaactttgcctgacgtaccccgatggaatctacaacgatcttagtgtagaacttatccatagaacatgcagaagctaacacgccacatcctacatatgggattgctgctaactctaaaagcccctgaaccgttccgtcctctccgttcattccgtgaaggacagggaaaacaacatcgatagaaatacgatcaaccttgccgtctctttctaagagaagttcctttcttcctgtatccgggcagatataagcactcgtcttactatttacccaggaaccatcctcaagatgatccagtctgtcaactaacttccactgtccatcctttgtgattcctaccataattacgttataaagatctttatcaatgttttcgattactgtttttgctgaaacgagagaaacatcatgttcagaggattttcctcccataagcactactatatttttattagccaatataattcatcctttcaaaagctcattttaattcatttcacgccttattctagcacattgaaaagcttttgaacactggattttaaaataattaagatgtaacatttacaaaaattttccctttttacggcaaaatccgcactaatttctcatatttcatgaaatcctctctggtaattccacactctccaatttcccggggattctttacacctttctttccatccgcatgataatcggaaccgccggaaataattaagccacggcctgcataacgttctatcacttctttttttatctcgtcctttgtcatcgtgccgccgtaactggtcttatcatatgtgtaagaagcttcgattccatcaagtccagcttcaattaaaacctctataaattcctgtctggacatctcttttcctttataagataccggctcagaaataagatacggatgcgccagtataatgataccgccaagtttatgaatctctttgataacagaaactgcatccggcttctctctcttcacgctaacttccttactgtttttcacatataactttgcttctttccagctttccatatagccttttctcgccataagttcaaaaatcattttcttttgaacaaactgctcctggactgggtaaccgttattctgaagaacttcctcccaggtcatttccattccctgctcgttcagaagatcaatcagcttacggtaactgttgaccttactgttaatcgtaaattcatctaattctttaaaatatggggcattccagtcacagccaagacagacaagatgtacatcatcaatatatgtctcacaggaaatctcaattcctctgagaagttcaactccaataccttttgcgtaggccgtaatctcctgtcttttgcccccgcctaactctatcatctctggcggaacaatatcatggtctgttattgccaaaatcttcacaccgcgatgtaccgcgtgtcgaatatactctacaggactgtcatttccatcagaacgattggtatgtccatgtaaatcacattcataatttgccagcatacttttccctccctgaaaacgtgtattttaaactagaaacttgttctctttcccgaaaatacttccagatgcttcttcacttcttcttttaccgcattttccacttcggtatcaaatggaatcggcgcaaacttttcaccggaaagaatgagttcttttgtcttatcaaggtacgcattcttcactaatgtagaaatgtttacctttcttccgccaagttcgataagacgggtaaatgtttctgcagataatccagaaccgccgtgaattacgactggagttttttcttttccaagtttctcaacgagttcaaaattaattttaggaacaccgtgataaataccatgcgctgtaccgattgccggtgctaccgcatcaatctgggagcgctctacaaattccatcgtctcttcaaagtcagcaccaacggcttcatcacttacaatttcttcttccacaccggaaataactccgatttctccctcaatcgcaacattcctgctatgtgcatattctgccatctctcttgtatttgcgatattttcttcaaatggcagatgagaaaagtccatcataatgctgtcccatccagtatctgcgcaaagctttccaagttctttattacggcagtgatcaagatgtaatgcaacttctattttcgcaccttttctcgcagcgtccacaatatcataaagcttctgcgctccaaaatgttctactgtccccgcagatgtctggataatcaggttaacaccgatttcctctgctgcttttactgctgcctctgctgtcagataattaaaaatatttactgctcctactgcgatattctcttcttttgcctttaacagtacattcataaatctgttatttttcatgatgtttcctccttattttgtcatgcactctcggaatctttttgtgcttgattttgtaagaaaatttttgtcagttgtgcccagatttttgaggtgtacgcagtgcgtacgttgataaaatccgggtgcagctggcggaaaatcagccgtaaaatcaagtgcgggaaagactccacgagtacatattcccataacaatatttaacttatattctcttttgatagtcccataatatcatacttgtatatacaagtcaatatataaattcacactacagcatatttaaagaatactttctgcaaattgaggcgtgaaggttgcaggaatgatttttcaaacacgctctgacgctattctttctaatcattaatacatctattctatcgtctttattcctcatactgtaaacggattttaattcggtctccacgaaatacgactttcgtatattcatatgggcggctaatctcatcataaagaacatcccttaacaataataatgggtgacctttttctaccgctaaaagttctgcttcttcgttagaagcaaccacagattctaatgtttcggatactttctttttgtgaatcccatagttctcgctcaaaagcacacaaagctgttctttctctaacatctctactgttagcttttctttgtatcttgcattaatataagatatatgaagactgatcggatctcccttaatataacgaactctcttaatcttaaatacagactctcctggtaaaagattgagctttttagctactgtctcacttgaacgctcttcctgacattcaacaatccttgtctcaacctcatatcccatcttctctaactgctcacgaataccgatataggatggactgactgtcacaatcttctctgcaacaaacgttccctttccctgcactctgtaaagaaggccttcttttaccagatcggtaagtacagaacggaccgtcattctgctcagtccataaatagaactcaattcattctctgatggaatcttttcattcgctttccacttttcagaatctattgcatcaacgagaatatcttttaactgttggtacaatggttttggactatttttctctaacatatttttctccttacctgtacaatcttataataaactataaaataatatctaataatagtcaagttatactaatatatctgccattttttcatagttatctgtaatataatttataaataaatgaataaatatatcaaaaagccgcgcccaggcacatgatacccaggcgcggcttttcattctttttaaaaatcagatatactaaatacgattatttaaatgctattattttttagaaaatcttcttatctaaagcatcatatacatcacaaaatctcttataagccgcatcataggctgcgtagttatctggattaggggtgtattcttttgtagttctggctacttttgctgcctcatgacagtctttataagcgcctactccaacacctgcgtaaagagctgctccaagacatcctgcctctccattttcaagaatctggattggatgtttgaaaatgtctgccatcatctgacaccataatggggattttgcagcaccaccggccaggcgaatcttgtcaatcttaattccagaattttcctctgcacgaataatatcatacatttcataacagattccttccataacggcgcgggccatgtctgcttttcttgttccaagtgtcattcctacaaaagttcctcttgcttttccattgattcttgctcctccagcaccctgaagaaatgaaaggaaggtaataccatttgctccaatcggtgaagttgcgatctgtttattaattaaatcatatgggtcttctccctgttcttttgccatgagtttttcatagtcgcagaacgtatctctataccagcggtatgaggaagcagcagtattggaaaatgcttcaatggtgaagtttccgcatccatgatttccttttactacaagtctttcttttggatcacgaatggatttatcagatactacgaaacaggagccaaatgttcccattaccaaaacagcagttccgtcatcaactgcgcccgcaccgaatgtacagcagttctggtcatgtgcgcccatacagattggtgtgcctactggaagtcctgacttttccgaaacttcttttccgatatgacctacaacttttcctggttctttcacgatctttgcacgttttgaaaggtcgattcccaaaatatcatgcatttcttttgaccaacactcgttatcaacatccatcattccctcacggcttgcagaagaataatcggtatagtaatcatctgctccgaactgctttaagaaatagtcctgcattgtggagaataatgctgtcttttcccagttttccggctcatgtaatttcagccatgccagttttgcattggaaaaagtagttcctaccgggtcacctgtctgtttgtagatctcgcttcttggaatacggcttgtcaggtattcaataccttcgccctcacctcgaagatcctgccatccaacccaaggtcttaataattcgccgttctcatctaacattccgattacggaaccctggcttgagaatccaaatccaataatatcttccggattaattccagatttattaattgctgtcttgatactgtcataaaagttaggaagtaagtcttccgtagtctgctctacccatcctggttctggataataagaaggatattcacgataatcgcttcctactaactttccatcaagatcaaagatacatgttttacaacctgtagttcccccgtctaatcctactaaatactgtgccatatgtaactcctccctattcaattaacgtctccgtaaatgaacgaatacctcctccaaagatatatcgtttgtatctctactggtatttcccttataccttatctcggttcaagcaccttatattgtccttatgtataaaccgtattttttcttaatatatcggcctgccgccttatattaaattatcggcttattcttatttatctcctgtgtacgctggtattaagccgatttttcttaaatcatctactgcatcaagaatttctactgcggctcttgttccaatcaattcagcccccgcctgaatgaaacagaacgcattctgtggtcttgggtccttcactcccgcaacctttacctttgtctttgttccctttactgcatctaccatgagcataacatcctgaacagatggcccgccatactggcctgtagatgttttaacccagtcaattcctgcttcacagactaactttgttgccgtcacgatttcctcttttgtaaggaaacaggtctcaataatcatttttgtcattacgccctgtgcggcatccacatactctttaaattctgcaagaatcttatcgtattttttatcttttaaatctccaacgttcatacagttatcaagtactgttgctcctaaacgtaccgcttcagctgtctcaaaagccttaaccgcacttgactgctggccaaatggaaatccgatcgctgctccgaccatgatatctgttccctttaactcttctgctacaattggagtccattcagaagatgaaaaacaaaatgctttacagttatattcttttgcaatctgacaccctcttctgatgtctgcttctgttgactgttttggtaatacagagaaatcaaataatttacccatatcccattttgtcattttagataaatcaaccataactttgccctcccgttttcatatcttcaaatcatctatactttgctattatttattctccttcatatggaggaataattccaatctttctcattgtatcaaaggaatcaataatctgtggagcctgtcttgttccgataaggtctgctcctgctcttaagaatacatatgcgttctgtggtcttggatcttttacaccagatacttttactcttgtatttgttcccttacaacagtcagccattaagattacctgctcgagagttggtcctgcatactgtcctgtggaagatttaacccagtcaattccagcctcaatacaaagctcacatgctgccttaatctcgtcatctgtcaggtagcatacttcaataatcatcttcgtcattacgccctgtgcagcttctacatactctttaaattcctgtttaatctcatcgtatcttttatcttttaatgctccaacattcatacagttatcaagcactgttgcacccatacgaacggcttcttctgtctcaaatgcttttactgcacttgtctgctgtccaaatgggaatccgatcgctgctccaaccaggatatccgtcccctttaattcttctgctacaattggagtccaataagaagatgaaaaacaaaatgccttacaattatacttaattgcttctttacagcagtcacggatagtctgctctgttgtctgtttcggtaaaatagcatagtcaaaacactttcctacttcttttttggatttaatctttgaaaaatcaatcatttgttaccctcctcattttttaaaaattcttttatacccccataaactccatctgcatctaacttataataagccatcagttcattataagggccattgctggcatagcagtgcggaattccatgcatttttatcggaacgtttataccattatcattcaatgtttccatgacaattgttcccaatccacctttgatataatgttcctctatcgtcatgactctgcctgttttctttacagaatcacaaataagctctgcatcaatcggccacacagtcggcattcctatatgttccacctggatgccttcctcttctaatcgctctactgcctccattgctgccattgtcattgaacctgtcgtgattaacgtaagtgcctcgccttctgtaatcttacgtccttttccaatgacaaatggttctctttcaaaaagtaccggaatctttgggtttccgattcgcatataaaccgggccattcatggaaagcattgcctttactgcttcttcaatctcatatggatcctgcggtgctaaaatagtaactcccggaatcattcgaacaattgcaaaatcttctaacgaatgatgtgtcgcaccaagatcggaataagtaatcccacagtttcggcctactacctttacattctgcttcatgtatccaagatcatttcgaaacatttcaaatggtcttgccgttacaaacggtgcgattgcacaaaaaacaggtacttttcctgtagtggccagtccagaggaaattccgatgactccctgttccatgattccacattcaaaatatctgtctggatatttctcaatgaattctccaaatccagaacttttaccactgtcggcagaaagaacaacaatatcctcattcttttccgcctcctgtgtcacagcttttccaaatgtttttctcgggtccatgtaattatcaaatttcatcttcataccccctaagctgttccatcaaatctttttctaatgcatcacaatcttccttacttggattccagtaatgataggacgccttgccttctccttctttcagtccctttgcctttacagtatgagcaacaatcatagatggttttccttcttcaaatggtaatgcatcaaatgcttccacgatttcatccatattgtttccatcaatttctcttaccgcccagccaaattctctaaacttatctccaattggagtaaaatccattacatcggtaaccttaccactaatctgtaatccgttaaaatctacaattgctgtaagattatccagtttataatgcgctgctgccgctgctgcttcccagttagaaccttccgctaattcgccatctcctaaaatggtgtataccttagatggcttcttatccagccgtaatcccattgccattcctgtcgcaatagaaaggccatgccccaacgcaccagtacttgcctctactcctggaagcttatgcatattcggatgtcctgccagcttagaatgtaaatgtccgtatgtatccagaatttcttttggaaaatatcctttttcagctaagactgcgtactgtaccatactcttatgtcctgctgataaaaggaacctgtccctgtcctcccaatcaggcttctctggatttacattcatcttgtaaaaatataatgcggtaaccatatctatagaagaatacgttcctccaatatgaccatgaccactggctctcaacattcgaactacattcagcctgcatttcgctgctgtttctttcaaacagcgtatagtctcccttctcatctttctccccctccaacaccttaaatattccgtgtcgttcttgtatatacaactatatgccacattatacaaaatgtcaaggttttttcattagattttatattttatatgaatttttatacatactcctccttaaaagcatcctgaaagcaaaaaaccaacaaataacatgcctctctctcatccctctattttttcccagccctttaataattttttctccatacaagggcaggtcccagagaaggacaatatataaaaatgtgcctttgagcaagctcttaacacgagtgcggtaagcaagtgttaagagttcagtgaaacgaagcatttttatatattgtccttctctgggaccgtctgtttattctaaaaaattactaaagggccaggtactacattacctgacccttttaattattcaattaatctaaaattagaataattaactcatattatttgttgatgctccaataccatccatatgcattacggaaagccttcacatcactgctggaaagggagcttaccatctggctgatatagctgtatgtcttaggacgctggctctttaatgcagatggattctctgtgtaatcacggaatgattctgcaaagtattctgctgcatcctgtgttacatatgctttattgttgcctacataagcggacttctcttcattataaattcttgtaaattctgaggactgatcaatcttcttaccattgcgtccctttaatgcagatacgaaatggcctaactcatggagtaagtatgaggactgacctctctttaactggatattatgattctttgtactaaacacaccagttgttgctaatttggaattaatcttaagttcaaatccaaggtttacaaaggcatcataaactttagaatctacatggcctttaatatcactgaacttggaaattgcaaatcctgaactggaaactgctgtagaagctcctacagaagcagcattattcgttgtagttgttgtagttgttccaaatgtctgagttgttgtcttaacagttgtaactactgtagtccgaattgtctgtactttggatttcttcttagtagatgtcttctctgtagtctgaacagttgtctctgttacagtctgtacggtagctgtcttctttgtactcttcttcttagaagtcttcttctttgtcgttgttttagtctttttcgctgctttctttaaagtcttcttctttgtcgttgtcttagttgacttcttaacagaaacctttggtgcgctggctaatggtacttcttcttcaccagctacgatctcatctgtacctgtctccggcatagtatctgtgatatctgcaactgttaatcctgtaccgccattacctgtataaaaaataacacccgcacataaaacaagagctactactaaataagctgcagaagctaaaaacgacttgttacttcttttcttcataaaaactcctccttttctgataagtgcctcgcttatggcattatcaaatgttacgagtttattatgagaatatgcggggatgaggactatgtcctcttaattctacaaaaaaaccgcctatatctctagcagatacacacggccactcataatattcgataatattatccatacgcatcaaaacgcggcaaccggctgtcataggctatgcccttagacccttggctttgcgtcccctgctttcacaaggtttgcccactagaacatattaatttattatttttataataacacagaggattcgtcacgtcaatattttttcccaaatccgtactaattgtacacctttaaaagttatccaccatactagagcgtgtttgaaaaatgctttctgcaagatgtgcgtcgcaatttgcgggagatttcgcctgaatgagggcggcgtagcgggctacgtcaactgaatgaaggcaaaatataccgtaaattgaggcgtgcaggttgctggaatgatttttcaaacacgctctaaaagcttttgtgccattaattccggagccgttgcataatccagtgccgtctccctcgttattttcccttctttatataactttgtaatatacgaatccattgagaacattttctcctgcccagaagaaccgatgagtccatctatctgatgcactttattatctcgaatcatatttttaatcgcacggttgactgtcataagttcaaatgccggaatgagtttcccttctttatctggtaaaagctgctgggaaacaaccgcattcagtacggaggcaagctgtacgataatctgtctttgctgattagccggaaatacatcaataattcggtctaccgcgttggctgcccccagtgtatgaagtgtagaaaaaacaagatgtcccgtttctgcggctgtcatcgcaatattaatagtctcatagtcacgcatctctccaaggaggataacatcggggctctgacgaagagaagccctgagcgctactttatagctttctgtatcagaactcacctcacgctggcttacaatactctttttatgacgatgcaaaaattccagagggtcttccaatgtaatgatatgttcttccctcgtgctgttaatctgttcaatcagacaggcaagtgttgtagactttccacttcctgcggaacctgttacaagaacaagaccctttctgtattctgcaagctgcataatctgagatgggatactaagctcttctggatttggaagccggaatgcaatcagacggattactgctgccagagagcctctctgacggtaagtagaaacacggaatcttcctaagtttggaatagagaaggaaaagtcatcatctccatttttctctaatgtttctatctttctttcctgtgcaatcacataaatatcttctattaacttacgggtatcttctggcatcagacgatcccccacccttatcatctttcgattaattttataagttaaaggtaatccggctacgataaataaatcagatgcaccctttcccgttgcttcctgtaaatattcctgtattcccatttcgtctcccctccaatgttataatgttattcgccactctgatatacatccagagaatcatcggcctgccagtcatctgatgagcaaagtttccatttttgtatgtaatactgtggataacctcctgtttcatctagctgtaatgtaacaacgagctgctggctctttgaaacgctttctgtcaactttatctggcttttcgcaacttttttaatatccttctgagactgcttctgcatattctttacagttttcacttttatctttttctcggtactcttagtctccgcagtttttatttctgcttttttttgactactcttagcctctgtagtttttgtttctgctttttcccgaagttcctgattcttcttcgccagctgctcctgcacattattcactgcctcgtaatattgtgtggtatgctttgctgtctttttactaagagaatagtctgaaactgcattttccagagacagaacagcaaatgcagcaaggcaaatattcataaaaattaaaatgataagtgagataccgacattcattacagggatttctcttttcttcataaataaaatcctttcgtttgccataggcggaaacccactacctttaggtggtgggaggagccttgttaactgttacccaatatgctagcaatatctatcggagattaaaggtcggaggtgtaagccgttagtacgactgggcagttacaagcccatgacctttaggtcgtgggtagttgactctggaatgtacttgtccatgatatctcgttcttttagggtatataaatactcaggttcaaatgatagatttcttcttttttcgaactttctcctttagaattctctccagaatacaccgcaatttttaccttttttaaatcgtcttcctgcgcctgattctgtgcctgcgttacttccagccagtacatcttttcttctttatcacactgattccagtctttatcataataaacagaaatattatccagagaatctatatccttttctaaaatttctgccatagatgccgcttcctgctgagcctgatacagattttttgcatcctgactcatattgtgggactttacaaaaaactgtatacaaattcccgctgtaatggaaaaaaataaaatacagatcattaattcaattaaaaataatcccgatctggaatgtcttactcgtttcatttgctatcttccccgtatattcttatatacaataattcttcttgtccgtctccgctaagttctatctgcaacaaatcctccttttgcttcgtaacagaaaatgtatctgctgaaacaagttcctgcccgctgctccagacaacatcacgtcctttttttgtaaaaagttcccgcagcttgcctttatacaaataaatgtatgtcacatagtcgctatcgccctcttcataaagtgcaattactgtctgcccgtcttgtgaaagaacttctatctgagattcactgctgtactcccgcaccttttcctgcaaatacgttgccgctgtccgaatagtataattctgctttaatccatccgttgtatcctggtatacatgggcaccggaaagaaccaatgccagtgcacaaaatccaaaaagaagaataaaaatcaaaggaaaaaccgtatcaattgtatgtatttgtttttgtttattgttcatagtgcttcccttttctttttattatagttatttttatacttttactctcatgattttaacttattgactttttcccttctaaatttcaattctcctactttttatcttcgatttaataaattcttaatttcataattatctttgattcaataagtttttgccctcataatttttcttcttcattttttactttcctgtaaaggtatcactttgacctccggtctgatgtttttagcaataatctcataggtcactttatacttgctttcatcccatgtgattccataatgctttttcagataatcaagtgaatctggataggctccctctacagaataacaatgtactgctgactgaactactgcatttttcaggctttcctgctctttttgtgctgtagcattcgtcacagaattcactccataaaataacattaccatcatcaaaatgaaaatgcataccggcaaaatatatccttttttataatcttttttctttttttctacattctgttccatcgtaattcatcacctgctatccaatcacagaaagtatccccataagaggcatcattacggatagtaacattcctccgacaagcacagaaagcacaatgacaagtgttggttcaataactgatacaaaattctgaatatctgcagttacttcaccatcaatctgtactgcaattttagaaagtgcctgatctgcctctcccgttctttctgcaatcatgatcatccttgactgaagcggggaataaatttctgtttccctgattactttagaaaaagactctccttcaaacattttttctttgcagttcattaacttttgcttcgtttcctcatcattttcaagcaaggttgctgccatgtcaaaggaacgtccataatccataccgctctgtaatgccatagaaaaagcagacgatactctggcactgttcagtctttttacaatagactttgtagaaaaaacctttcctgtcagtctgcgtaatgccacattgccttttgttgtttttaagagccaccataccccgactgcaaatacgcaaagaagtactgtcggaataatccagtactgtttcaaagcttctcctgcctttaaaagaacggcacctggcccagtaatctgcgttccaagctgctcatacacctgattaaataccggtacaacctttacaaccattacgagcataattgcaagaagcatacatagaatcattaaaggataagaaatcgcattcttaatatcctgcatcgtattctcttcccgctcataatatgcggcaagccctttcatcacaacatccagattacctgtttcctctcctattttcgtcatttgaatcacataacttggaaaaagtccagtttttgtaagtgcctcatgaaagatacctgtttcttcaagacacattctcatatcctcatacatttttttatattctgtattgtgcagctccacatcctcttccataatggaaatgccttcaagcattgataatcccgactccaaaatcatcccgctctgctcacaaaatacagctacttcgctatttgataacattttgcgtcctttcatatgtatttattttatatttatctcagtcgagaagactcccacctcttcaggtgatgagtaatagtaaatttttctcagtgggagtccaatctccgactgagataaacgctccgcgaggatgcgcagtgattctgataggaacatgtcagcttcgctgaccagaatcacgcgccaagtctcacggacgttcgacttgaacttgtaatcatttacaaatcaaaaatatttgcaaattctcatttaaattatccgccttatagaaaccagctcttttagactcaaataatcgcttaagtaattcaagaatgccggggcattcttgaattagacaataatacttttgagtaatctgttttaatgtatatattctatattataatttgaggaatcggtaataaaatcctgaattccttcgccgcctcctgctgcaaaagtcggatccatcatcgtccagttctttccgtcaaatttaatgacgttatctacccagccctgctcatctaaataagtactgatccatgcatggtaaatgttcgttgcatagccaatatcaaggcgcgtcggaattcccgaagagcgtagcattgctgtcatcagcgccgcatagtcaaaacagattccttttttggtcttcagtgtgtcatccacattcggcagataaccactttttaccgttgctgccttttcatcgtcataaacaatattctttataacatactcatacacttcctgcactgcctcaatctccgtcttaccttttgtaagcttcttcgccagcgcaacagtctttgtattctcatcaaaattcacatactgattagaatataaaaacggaagaacttcattctccagtgtcacatctactatcttggtaaaaacaaccgcatatcggttatctcccacattctcatatgccgttactgcataacttccatctccggcagtcagcggcaaagcgttgtatttcccatctgggtcaaaataatatcgatacggaatgttatcgctgccctctacctgaatcaacagcttgtctgcactccccgtatacgctgccataaaatatccctgatctgtatgcgataaatcaagcttcacgccctcatgttcttctgtcacttttccatctgcctgtggaagaaaaatctttcctttatgatagtaattcggagcagcgctggaactctcctgttgctctgttcctgactctgatgttccagttccagaagtcccacatcctgccaggcaaaatataagtaaaaaaatgtttcctatccataatagacgagaaataatctgttttttattcttcattctcacgttaccgtcctatgataatgttacttaagattataccgcatttggtggaaagttccaagaaagaaacagatgtttttgccgactagctaaagctattggtaacgaagaaagcatccgaagaatgtattgattttattctgttgtgctaaacgctccttttcgcccaatagggcagaaacttctttaatttggtgaaataatgttttgttttttccagccattttccctgagttaattctgtgatctttttccactgtttttttccgctttcggagagggtaaagtttttttccggggtgtagcagaggttgggatagaatgcacaccaccagttatgtccggcagctttgccaatatctacccggagtgcctgatattctcctgcggggaaaatagcagttccgtaatggcgtattggaaatctttctttggtaaagtaaacacggacaggcttcccgtctgaagcgttcgctgccacctgtgcgatttcttctgttttttctgcaagattctgtttcaattcctgtgcggagtctgctctgtatacatcctcctttacataacgcagtaccgcatctctgacaataagctttctttcctgggcttcctttttatcagaatctgctctcacatgaaatcgcagagtgttatcgtatattggaccggtttgttctaaatatacctgatacagcaggctgtaactaaatagtaaatatattaaaagtgtgaatgatattgttattttattaaaagtcttcataggtggagtattaccatttaattcgaagaataaacagacgccaccgaagagaaccttggtgtgcatcccgtcaagtagacaattaaaaaaatataaaatttttgtgttgcccggtcggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcgttaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagccttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatgggaatgttttatgcaatattgaacgatctcgacacgttcttcaaatgtagtttttctgcctttagtcatgattggtctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgcccctttcagataaacagttttatttttttaactgtctacctaaaagggagcataccacctatcccctatatttgcgactttagtcacggcggtttgaatgttcacttatacgctcacatccaaaccttgctccgaggccgcaaatataggggataggttctcttcggtggctgtctttggctgtttttagttgaatctctcttccggctcttatcttcttcactgttttttcggctggattttgttaaatcaaatggtaatagttagaaatttgccaaattaactgcttcagccatagtcagaactctgaaagataccgcattcctatttgtggcctcggagcaaaggttggatgtgagcgtaggagcgaacatccaacctgctgcgactaaagtcacaaataggaatgcggtatctttcagagttcgtctgtcattatttttaaattcccgttttctatagtaacccggtacagtgtaattttatcctgttgctgctgtttggcacgaaggtagtctattggcgtttcgcagatttgtccggaatatttttctttgttttgttctgcgagaaggtttatttcctgtcctgctgctccggcaggaatattttttattttgtatagttctttcgggttttcggggcatagtgccagaaggacattcggagatttctgccactcattatcccattcttttagcagacgagtgcattctgttttatttgctgctattcccgaacctaagaaaattgtataaatatgattccactcggtttttccggggactatttccaagtatttttcttctaattgctgtagattccgggcttctatttttgtgatctggcagggaatttcgtcgctttgcccctccatttcgcttaaatttgcccgagctatccaaaactgataagcattttcttcatcagcgggataatcaacgtacatggataagatatagtttttttcttctacatctgtaaggcgctggcagccagttaaggaaaaaagaattgggaaaaagattaaaagagttattcctgcaaaatactttacctgcttattgttcttatattttgcaatattttttctttcttctttatctttttctgttttttcttgataattgaaatctttctgtcttttaaaaagccaaactacaagtggcaatattaaggacagcgggaaatccacaaatgccttatatttgagataaaacgtccacaaaagagtgtgtttttccacaacgcaagtcaagagcactaagcagacaaaagtaattcctaaaaaatttttcaaacatcctctagagcgtgtttgaaaaatactccatccataatagagataaccgcttaaaaccgccatcatgcacagtatccaaaatataatcggcaggatatcaaatcgttctaagaacccgcccggcattcggattagctgcatcattttgatgactggccattctgactggcttgtgagagttgggccaagtgttcgcacggaaaggaaacaaaataaaacattacagagaattgcacctgcgacggctgttattatgtcccgtattgctttatcatctttaccttctctattatttttaccttctttattatttttgtcctctacttttctattttttgtttcggttcctctttcttcggcagcaggcctcaaaaacaagagaaattctattggactgctgcacagtaacatcaaatatccgtttcccatgcttcggaaaatattatctgaaagaattccttgccagagttctcctgcattccctatctgcattgctttttcaattccgataaatgataaaatcacagcaataaaatacgtcgtgataatccactgaaaaatgatttctaaaaatctggctcttttttgtaatgttgtatacaagctgtagcaaagcaaaatcgcagcaggaaaaataataaataaaaagctgctttctggcatataaacagtctgaattgtcttaccaaagaaataaaaaagtgctactgcatttatgaaaaaacgaatcatgtatacaaattttattggctgtggtaaaacttccggaaaatttatagatttaagccttgtttgcatttttgaaacattaatatttgcatcccttgccagacctgtcttacctatttttctgttttcaaaattttcttcacttattttcccagaaaaaataataaaaaaggcaatcgttcccgtcaaaaacaccccataaaaaatcaggctccaaaagccattctgttctttatagcaggcaaatgccggtatagataatgctcccgctccaaatgtttctataaagatcattctgcgtaactgccttgcagaaatcttattttcatacattttatacatcctcctctttgaccgtcccccattttattttcattctattttcgttttcttttcttcatccttttatgaatcattacatcttctgcctgtaaatttggggatagcgtatctatctttttcgaattctccggccctctctcgtaaatactggtctttttttcatataagcaaatggatagcgaacataatgatcctttttatcatcataatttaagttttccccacaaacagaaggcagcatatatggaacaccgaaggattctatctgagataaatgcaataataatgcggcaaaagtgagaagatagccgtaaattccccatattgctgcagtaacaataaaaagaaactttaacaaacgaaatacggcgccaaaggattcatttggcacgataaatgatgcaatagctgtaaaagatacaacgataacaacgattgtactgacaattcccgcttccactgctgcctggcctacgatgaggccgccgacaataccgattgttcctccgagctgtccgggcaaatgaattcctgcttcttttaataattcaaactgaaattccataagcaaaacttctaaagcaactggaatgacgatgccagttcgtgctgttgcaatggataacaaaaaggaggttgggagcatttctgtatgaaatgctgctatggcaacatacaatcccggaaatcctatcgcaaacaatgaagctgcaaagcgaagcaaacgggcaaatgatgccacttcaaatcgggtatagtaatcgtcacctgcctgaaaaaacatttgataagtgacgggcaaaattaacacgcccggagagttatccacaacaagaacgattctcccctccagtaatccacttgccgccttatccggccgttctgtatgttgaaattgtggaaatggtgtccatacattctcttctaaaagctgctctaccattcctccatctaaaataccatcaaagctgagtgcatttactttttgtcttaccttttcaagaagttccggctgaacaagatcatccatgtatacaattgccaaatctgttttggagcgctccccaaccatcgtatgctccattttcaggcgagaatcacggattcggcggcgaatcaatgctgtattcattcgcatattttctgtaaaactgtctttcggaccgcggataaccatttcctgctgggtttcccctacccctcttgatgggtatttctttgtagataaaataattgctttcgggcagctttccagcaaaagcagggtatttcctgataaaatatctgttaaaatatcttcaaaactttcatcctctttccagtccactgtttccatcacatgattttctacataagagagaaaatcatgccctgttttttcacatttatttttaaggagcggacggatcacgaagtcttccaccatatctgcatccgtcattccatcgacatagatgactgctgcttttttaggctttatttttttattgttctgcgtagttttcactattcttttcgaaactgtttttctacctatatcactgtctgtattcgcatctgtttgctcttccataatactgtttgtgtcactgtctgtatttgcatctgtttgctcttccataatactttgtatatcagcggtgtctcctacataaaatacattctttacaatatccccgcttcggtctaatgctttctccaaaaatgcgtaatctttatcaaaattctgggtaagatttccttttattttctggtctctgttatactttattcgcacttttcccctccagctctttttaataggccactaaaaatatgccactaaaatctcttatttattattcttaaacttttgcctgcgggcttatcaacttttaatattttactggaatctcaaattgttatacccgcataacattaagaatatttctccctatattttccgcaaaaatactctgttagtattgagaaattttttcttttttatacaggtgtttctttcttgattttttgcaaaaatgcgttataataattgtatacaagatacagaggaggtacaatttttatgactcagcccttacatttgaaagcatatgccaaggtgaatctgggactggacgtacttagaaggcgggaagacggttaccacgaagtcagaatgattatgcagacagtgaagctttttgactacattactttacagaagaatacatgcggacagattcgtctttcttcgaatctgccttacctccccctcaatgagaagaaccttgtctatcgggccattgacacgatacgtactgcatataatatttcagacggtgttgatgcagcaattgaaaagcacatccctgttgctgcaggaatggccggcggaagtaccgatgctgccgctgctctggtaggcatgaatcagctattttctcttggaataacacaggacgagcttattaaacatgggcttacccttggcgcagacattccattttgcattatgagaggaaccgcactttctgaaggaatcggtgagatattaactcctcttccttctattccgccatgctggtttttaattgtaaaaccatctttctctatgtctacaaagtttgtatatgagcacctgcatctcgatgaacagacagcccatccagacatagacggaatgattcaggccatcagccacggtgaccttacaggtatcaccgaccgtatgggtaatgtattagaacaggttacagaaaagcattatccagctatcgtacagataaaaaaagatatgagaagattaggagctgtcaatgcgcttatgagcggaagtggctccaccgtatttggtatatttacctcaagagaagccgccggaaaggcagctgaatttttccataatgacccgggaatccggcagaccgccgttgtccgcccatttagtaaaaatctcccacggtcgaaatcgcagaaaaatcataatcatttttcgaaaaaaaacagttcgctgacacagggggataaatatacagcgaaaaagggaaggagaaacaactaatgaaagacactaactttaatgtaaatgaatatctgccacttcgtgacgttgtatttaacacacttcgccaggcaattattactggtgaattcgcaccgggagaacgtctcatggaaatttctcttgccaaccgcctcggtgtaagccgtactcctgtaagagaagctattcgtaagttagaactggaaggcctggttatcatgattccacgaaaaggtgctcaagtagccagaatcacagaaaaaaatcttcgtgatgtcatcgaaatccgtactgttcttgaagaattcgctgctgttcttgcctgcgaacgaattgatcagtctgggcttcatgatttacgtcaggctcatgaggacttcatccgttccgtagagaatggggatattctcgatatcgtagataaagatgagactttccatgataccattttccgcgcaacaaacaatgaccgccttatttctattatcaataatctgcgcgaacagttctatcgttaccgcatggaatatgtgaaagatattcgccagcgctctaatcttgtggaggaacatcgggaattgcttgatgccatttccagcagagattctataaaggcaaaggaactgatgaaaacacatctgcttaatcagcagcaggaagtaattaataacattcaggaagcataggaagggcggacgaaagtcaggcatccctattatgcaaaatttacaaaatacaaaaccagtcacaagaagcatctctttccttcaagagaaaatctgctctttgtggctggttttcattttaaatgccttttattattttgtttttttattattgcctatcagatctccccttttcagatgaagaaatacctgattacattttaaatgttttccttcctgtccttttttccgtgtacggataaggacacgaattaaaagcatgataagaagaataattcccataacggatgccgtgattgtcgggtcaatctggaacgcttctgctgtaacatggatatgctgcggttctccggttccgatacaatggccacgcacaagcagacgatgtgtattaataccatacggtgtacaggtcatcagggtacagtaatcctttttatcttcaatctgcaggctatccgtttcatctggaagaacgatagaaatatcatcaacctcgtaagtaatctctcgattcaaaattgtaatagtaaatgtatctcctacttccattttatcgaggtctgtaaaaagctttgcgctcggcagaccacggtgggcagaaataacactgtgcgtactgtctccgccaaccggaaaactggttcctttcaaatgtccggccgcaatctgtaaaataccctcatctgttccatgataaatcggaagctctacaccaagcttcttgattgtgatataacccataatacctgtaccactaatatcaagtattttctcataacctttaatttcatccgggttataaaatgcagatggatttttcgcaagcttcttattgtacttctccgccgcttcaaaatacttcgtataatcctccggcttcatttccgacaccttttcatcgtatgccgcaatcgcctttgactgatgcctctgattaatataattgctcacggtcggatataacatcacggacagccccacgaggaaaatcaatattaaaatgatagtggtaatattcgaactcaacttcttttttttcaatgttttctttgattttttctctgacttctttccagacttcatagttctctccctgatgtcatttccttttgtatatttatgctctcacaaaatcttgtttgtgtaactgtgcaggcatatatttacctttaagattgggacaggagctaaaagcccctgcccctgaaaatctcataatatcaaattgttgttataaacattcagaacggattagttctcagcacgtctctttgtgataagaagaactgctgctccaaccattaagatagcaccaacaacgtagaagattgttgtaccgataccaccggtggatgggagagtggaacctttcttgttgactacgtttgtaactaattcactcttgtcatcattaggtgcaaatgtaatctttccatcttcctgattaccagtcaaactagtaagcacacctgtacgatttgtaccatcccatgtaattgttgtattaaaaaatatgcgtcgcttacggttctgtcgtgctaaccgccgacgttcaagacgtatctctttaatcgaggggatgtttacttcctctttactcgtccgctccattcagcatctgctccttttctgcggctttctgttcttcttccattgaaacgttcgctgctttaatagatgtgagataatcatcggctgcggcctgggcagtagaaaatatatcgttcaactgaagggcagcctctgcaataaagcctgcctctgaaatctgaatcgtacgattgcattcttcttctgcaaagattcctcattagattttaacgcatatataatttctattaattcaggacgactcatccttcttaattctttctctgccataactaaacctttccccggcttttaattcttaattatgctctcaatcttattaatgtctgcaacgtcatacatgatccatctaatatccccataatatagatgttgtatatacgtcttaatgccgtgtcttatttatgtttcttattttacaatcctcgttttttcttatcaataagttgaaaagaattatccttttttttacaatatttttatcattttcttgcttatactacataaaacgcaattatttaatgtaaatgcgtactttttctatatatttttaagcacaaaaaagacggaatcagaaattactctgaccccggcatttttgttcattacttttatgtatttatcctcttccagcaagaagtctcccatctttacggcaggtggaggatgtcactcccctatgagactttccatttcttttaacaggaacaatttctgccctgtttctaatggttctgtgagattttcattatattgcttcattttttctattgtcgttccgtaatgttttgcgatattccagagagtgtctccgctttttacgatatagcctgtaatagacggaatcctcgaaatttcttcctcactgtacggaatttcctctacttcatcaatcatatacattgtctgtggtgagaaaccggttacatagattccggcaaccgccctgatttctaattcgttgctgtccacaacataaccaccaatctgttccagcacaccgcgaatctcacagcggtctgtctcggctacttctggtatttctactaaatattcaaatggaataacgatttctttggactgaatcggcgcggtatcatctcctgctatataaagaactttgcagaaaatgagtccctccgttgcgatgccctgtttagtaagctgaaagtcttcgattcgtacatttccttctacattaagaacctgtaaaagtttatgaatctctcctgctgcctccacccgctgacttacctttgttttcgcgttattctggaaaatgagattttcaaatgtaatcggactggtttttaattttaattttcggtcatttgcatacatatctttaagcaaaggcattttaaattcccgataagctttcaggtcaagttctaataccgcctctatttccacatctcttggctcgccgtcaatatccggcttaatcactgcctgatggtttccgagcattaccgctatattcccaataagattctcctgactgtccgcacagtctaattcgttggtaaatggaatctcccaatcgtagtattgcagtgattcgctaccctcttctgcctgataaagaatgaacaggaaaagacttccccggatagataatttattttccatcatacggatatctacatcccgaagctgcattgaattccagagaatctctttgatattcggcttacctgctggcaggctgacacttgccttaatcctctgaatatcttttttattcatgataatttccgtcatggacggagactcatataagcattggacattttcctttttctcgattccagtcgtacactccacaaacttcatttcggaaatggctatgtgaaaatatataacagaacgcacaccacattttctggaattgataatggaaatcgtgagatcttcaaggtcggccgtcacctttgcgatatcgctgctttctgcactctccacattcataaattcttctatggaaaactcatgctccatgcaggaaatctgctgctctttatccgtactcagatacaaaatctgcacgaggaaattcccccgcaggcgcatacggtctgtcagcacttctatctcatcaatatgtacctcgcctcggctctctataatcttttccacatccggccgggtatccggcacattcatatcctcatcaagcgtaatctgcacatttttttctaactttaaaatacctgaacgaaccgctttcttttcaaccttcataaataaacctccacccaataaaacttgctatattttatgcggacacactctacccgtcttttcggcttcgttatcagtatatgttgcttctggctggtttatgattttttcaggactcaatccggcacaaaagttctgtccgcccacaacgcacaactaaaaagggatacgtcagcgtttccactacttcttcccccgctgccggacctattaactgcgtttctaagtaaagctgctccttatctttccagcattgctccaccctgacactgtaaccactataggatttctccccataacagaccaccaaatatgtatatttcgaattcttatatgcaaatgttcccggtttcttttttctctcttcaataatcttctgcagtcgctccggcatattcttcccactgcatatctcatactttaccgcctgcccctgctctttctttcccagtttgccgaaatgaaaactatttatgtttaagacggtgcaaccgttgaggcaaaggcagaatataaacacccatagtggaaaaaggactatggatgttccttgcttttttgtactttgagacatattctgatactcctgaaaggtgcttactttaatatatgcaaacaaaaggaaaatagtaatttgtggttgggtgaataaacagacgagccagtgaacctcttctcgagcaagcagaagctctcgcatctcgtccccaaatcccctcccctgtttaattcgtctgtagtttgtctaatgaattaaatagtaataaacctttttttatgttataattatcgcaataaagagataaaaacattttcgaaaggagggggattaacccatgcatatttctattccaaaacatgcctctgatattatcaagacactttctgctcatggttacgaagcatacgttgttggtggctgtgtaagggattctattcttggaaaagagcctgcggattgggatattactacttctgcgctgccggagcaggttaaagcattatttccaagaacaattgatacaggactgaaacacggtacagttacgattatgatggataaagtcggatatgaggtgacaacttaccgaattgatggaacttatgaagaccaccgccgtccgaatgaagtgacttttacctctgatcttaaggaagatctgatgcgtcgtgattttacgattaatgcgatggcttataatgaagagcaggggcttgttgatttatttggaggaattcaggatttaactgatcgaatcatccgctgtgttggtaatcctgcagagcgatttgatgaggatgcgcttcgaatgcttcgtgcagttcgttttgcaggacagttaaattttaagattgaagaaaatactaaggcggcgattgaggcccagcatacatttcttaaggatgtaagtgcggaacgtattcagacagaattgatgaagcttttggtttccggccatcctgaaatgattcgcgctgcttatgagactggccttacaagtgtttttcttccagagtttgatcgtatgatggaaactccacagaataacccgcatcatatttattctgtaggtgaccatacagttcacgctgttgaaacgattgccccgaatccggttcttcgtctcacaatgctgcttcatgatattgccaagccagagactcgcacaacggatgagaatggtattgatcatttttataatcacaatgccgtcggtgctgaccttgcaaaggctgccctcaaacggcttaagtttgacaatcagactacgcacatggtcacaacattgattgcaaaccatgatattcgttttaatgaccctttaggtacaggacgtaagcatgtaaggaagattattcacagagtcggtgtcgatctttttccttatcttcttgatgtgatggaagctgatatttccgcacagagtgattttatgcgccttaaaaagcttactgcccttaaagagacaagggaagcttacagagagattcttactgcaaatgactgtcttactttaaaggatcttaaaattaatggaaatcagttaaaagcattaggtatttctgaggggaaaatgattggtgcaattcttaatgcattgctcgcacaggtgcttaataatcctgaattaaatgaatatgagaaacttgaagaacttgccttgaaaatttatcaggaagttcagtaattttacacataacatccctcttttacacataggatagaccatgtttattccgtaatccgttgtctgtcttatatgtactctgagaatctttctgcgcttgattttgtgagaagttttttagagtacattagtttggagggatttttttgagcgaaaaatacaaagaattattagagcagtacgatgtaaaagttctgtctacttttcgaagccgcggaactttccagtgcgagacagagcaggggcttgccttattaaaagaatatcacggttccctccagaaacttgctctggaatatgagtggaaagaaaagcttgctaatgctggttttcttactacagaccgttattttctgacaaaggaagagagtcttgttacctatgaccgttaccgcactccatttgtcctgaaacattattttaaaggtagagaatgtgactgccggaacctgtctgatgtggctgcttcctgccgaaatcttgcttttttacataaggtatcttcttctattgaggaaattccttttgaaaatctgaaaacagaaaccacaagtcatctttttgagcgaaaaaaccgtgaactccgttctatccgaaaatttatcgggaaagttcgcgggaaaaatgacttcgaacttctttacatggattgttttgattcattttataaggaagcttcccatgcccttgcacaccttcttaaagcagaagctgatctcgctgatacggactgcggcatgtgccacggcgcatatcattaccataacgtattaatcttaccggattattctgttgctacagtcaattttgaatctttgtgttatcagccttaccttttggatctctatctttttcttcgaaaaactttagaaaaaaatcattacgactatgctttttttgagacagggatttccggttattctatttaccggcatctcacagaaaaagattttcttttcttatatttactttttttatatcctgaaaagttctggaaaatatccaatcaatactataatcatcgaaaaagctggattcctccaagaacactggaaaaactgcaaaaagttctggcacagaatgaagaacgacattcttttttgaagcaatttgcagactttttgagaacacttaatataaatcttctgtaaaataaaagaaaagactcctatccctaaaagctatagttgcctgttcacctgtaaatatgctaaaatgttttaagcatatttttctgggagagtgagtgattcgatgggctatatggctttataccggaagtggcgtccgagtgattttgatgaagtaaaagggcaggatgccattgtccagacattgagaaatcagattatttacaaccgaatagggcatgcctatcttttctgcggcacccggggtactggtaagacttccattgcgaagctttttgcaaaggcagtaaactgtgaacacccggttaatgggaacccttgtaatgcctgtccttcctgtcaggcaattaataaccagagttctcttgacgttttagaaattgatgcggcttccaataacggtgtggagaatattcgtgatattcgggaacaggtacaatattccccagttgagggacgttataaggtatatattattgatgaggttcatatgctttcttccggagcatttaatgctcttttgaaaacgcttgaagaacctccttcttatgttatctttattttggctacaacagaaaaacacaaaattcctgttacgatcctttcccgttgtcaaaaatatgattttaaacgaatttccgttgatacgattacgaaccatcttgtatccttaatggagaaagagaaggtggatgcagatgaaaaggctcttcgttatatcgcccgtgcagcggacggttccatgcgagatgccttaagtcttcttgaccagtgcatcgctttttatcttgggcagacgcttacttatgacaatgttctcgaagtacttggtactgcagacacttctgttttcagcgcactacttcgtaatattttaaatcatgactctatcgccgctcttgatatcattgacagcatgatcacagagggccgggagctttctcagttcctttccgattttctctggtatctgagaaatcttcttatcttaaaagatcaggagggtgctgaagaaagtcttgatatgtcaaaagaaacgattgccgctctaaaggaagagtgttctatggtagatactattgcacttttacgctatatccggctgctttccgaactttctaatcagattcggactgccacacagaagcgtgttctcctggaggttggcttcattaagctctgccgccccgaaatggaatccgatacggaaagtctttcggagcgtatccggcagttagaagacaaaattgcacaaggcatcccaatgattcctgcaaatggactggggaataccgggatgataaccaacaatggtacttttgcctatgatccatataccggtcagcctcttggcacttccggcgcagcaggcgcaggaacagcaggtatggttaatggaactggaaacagtgccgtatctggtgcatttccgcagggaacagaaggacagatttcaccggaagaagcattagaaaagcgtttttccccagcagaagctgatgacttgaaagaaattgcaagtcactggaacgatattgtaaatcaaacatccatgccgatgcagcagtttcttcgcgccgccagagttgcggtagctgacagcagtactattttgcagcttgtctttacaaataatgacctggcaaaagaatactttgagcgagaacatcacaaaaatctggatcttttatctgaacttgttgcagaacagacaggtaaggtcgtaacttttgaatgtacatccagtacacatcaaccaacggaacaatctaactatattgatttaagcaagattcaccagacggttatttttgagtaattaattattggcaaaatattatttctggtgtataaacacattaaagcgtgttaatgtgctcccggaatctttttgtgcttgatcttgtgagaagatttttttcagctatgtccaaatttttaaggcatatgcagtgcgtacgcctcaaaaatttgggcgcaactggcgaaaaatcagccgcaaaggcaagtgcaagaaagactccaagagtacgtaattattaaaatggaggattttattatggcaaaaagaggtggattcccaggtggtatgcctggtaacatgaataacttaatgaaacaggctcagaagatgcagaagcagatggctgagaccacaaaggcattagaggagaaatcctacgaggcaagcgcaggcggcggtgttgtttctgttactgtttccggtaaaaaagaagttactgctatcaaaatcgctgaagaagtagttgatcctgatgatatcgaaatgttagaagatcttatcatggctgctactaacgaagcattccgcgctatggaagcagactcccaggctcagatgtccaagttaactggcggcctcggcggaggatttggattttaatgaactattatagtacgcagattactaaccttattgaggaactcagacgtcttcctggtatcggcagtaagtcagcacagcgtctcgcttttcacatcataaatatgcctgaagagcatgtacatcatcttgcacagacacttgttaccgcaagagaaaagattcgctactgcaaatactgctgtaccctgacagattcagaagtatgccctatatgtgccagcaccaaaagagatcacagtacgatcatggtcgtggagcatacacaggacttagctgcttatgaaaaaacaggtcagtatcatggtgtttatcatgttcttcagggaacgcttgctccaagtcttggaaaaggcccggacgatatccgttttaaagaattagaagaacgcctgaataacccggaagtaaaagagttgatcctcgccacaaattccagccttgacggagaagctaccgcaatgtacatcaccaaaaaagtaaaaccgcgcggcataaaggtaactcgtatcgccagcggtgttcctattggtggtgaattagaatacattgacgaagtaacactctcacgagctttagatggacgagtggaactttaaaacagattattttaactacagattattataggaattgcagatacttgattccatttgtaaaatttaattatcaaattcttgatattaatttgggagcattacgttttatgtattttataactggattatcataatggaatcctgctctgcgagaagggagattacgatgaagagaattggtatgctgaccagcggtggagattgtcaaagtttaaatgctaccatgcgtggtgttgtaaagggtcttaatgttcttgagggaacagttgaaatctacggcttcatcgacggatataaaggattaatttacggcaactacaaacgactgacttcgaaagacttctcaggcattctgacaaccggcggaaccatccttggtacatccagacaaccatttaaattaatgagaacacctgacgaaaatggtcttgataaggtagaagcaatgaaatcaacttatcgctatcttgatttagactgtcttgttgttctcggaggtaacggaagccagaaaactgccaaccttttaagagaagagggtcttaatattgtctcccttccaaaaacaattgataatgacctctggggaacagatatgacatttggtttccaaagtgcagtagatattgctactcagacaatcgactgtattcacacaacagccgcttcccataaccgcgtatttatcgtagaattaatgggacataaagtaggatgggttactcttcatgcaggaatcgccggcggcgctgacatcatcctcatcccagaaatcccttatgacttaaaacacgttatttcggcaattcaacgccgcaatgaacagggcaagcactttacaatccttgctgttgcagaaggggcaatctcaaaagaagatgcaaaattgacaaagaaacagtacaaggcaaaactggctaaacgtaaacattctacagttggttatgaactcgcttcacaaattgaaaaagccactggtttagaagttcgtgtcacaattccaggacacacacagcgaggcggaagcccggttccttttgaccgcgtaatttccagccgtctcggtgttgctgcagctgagcttatcgccaaagaagattacggcaaaatgcttatcatgaaaggttatgatgtcgctactcttcctctggaaaaaacagctggaaaattaaaatatgtttctcctgatgaccagattgtacttcaggcgaagcatttgggaatctctttcggagattagggagctagagcgcgtttgaaaaatactttctgtaagatgtgcgttacaatataacagacgcccaagaagagaaccgataccctatatttgtgactttagtcgcggcggtttaaatgttcgcttatacgctcacatttaaaccttgctccgaggtcacaaatatagggtatcggttctcttcttgggctgtctttggctggattttaattgaattaaataacaaatctacttatcattgtgattagaaaccctcctacaagtcctccaatatgcgctgcattatctatgcctgtagaaaagaatccatacgataatgctgaagcaaccatgaaaatcattcccgtcaaaccaatctcctctacacgatgtctttttttctgaattatatcagaaataatacaatataaaagacctcccataacaccaaatattgctcccgatgctcctgcacttacagtattcggattatttccgagcgtaaatataatagatgttcctgcgccaatcaggcctgctccaatatatatgagtaaatatgatagttttcctgtgattctctctaagcggcatccaatgactaataaaatcaacatattttgtaaaagatgatctgctccaaaatgaagaaacattgaggtaaatagtcgatagtactgatgcttttccacaacatccatccaatctatcgctccatgtgccgccataaattctgcatctgtagtattacccaaaaaactcaagatcataaataccactacattagcaagcacaagtattgtattgactggcgttagcatacgtcgaagttctgttctttcttcagttattttctgctgcaaaaatttctgtgaaaaaggttctaaagaactttctagtccacaatattgggacttttgatattcataaatatacagttgtcctgcttttatatcaaaaaaccatatatccggatatttttccgcttcttttctttcttcaaaatctggttctcccttattaagtattaatagcaagtgttccacttttttctgatactttagcataatctggcgttctatatcgagcatttcttcttctctttgtttcaatccaattcgcggctgccctggaagaagtggcggaacaacttcaagtaatgagagcttatcgcctgtatctttccccacaaaatctttgaatcatactttattttctgaaacccctgatggaataaaaattcctgtaatgcttctacaaattccataaaaacttctcttttacctttctttatcttatgttctccattatagcgaggctgcctggattgtcaaatatcctgtatcagaaattcatattctttttttgcaaaacgtatgactgcaccatcttctaattgttcctgatttcctctttttatctttttcccattaagccatgtaccatttgtcgaacccatatctcgaagaatatatccctgtccgtctccctcataaatatcttctaaaataactgcgtgttctctgcttactgttttatcctgtatatgaagatgatttacaccctctgcacttccgatataaaaaggacaattttttattacatagataattcctaattccatatcccgtaacatcggatgacatattttaccatcttctttttctgattcgttaccataatttaaaatggttgttccttctgttcctgattcccaatctccttctgcttcccaatcaacttctgtttttatcatttgcggtctgttctgtaattctttttcctgaataaacttatcggatattgagcttccctgctcgcctctttttcggtgtctcactttattttgcttgtttatgttgtcttttatactattcatactattgcttttatttttttgttttatttttcgtactgtctgtgcactccatatgaatccacacgcaaacactataattaatagcattccgcctacggaatattgaaataactgtcttgtaaaaccgcttctcattccgtagaatacaaagattccttccaatattactgccagaaatgtgcatattacagaaattatttttaaaccattgtacacaatgagatagttattttcattactttgacttttacttctattatttaagtctttatttttctggtttctattactttgatttttatttttttcatctctatttctctcatttctctgaacttcccgtctgctatttcttctgccattttttattcctatctgaaaatctcctgttttttgtttcctgttatttggactttctattttttgtttttccagttctaattcttccttaaaaaactcctcataggaaatactttcattattactccttctatcctgttttattttactgctgtctctcacttttgcacttgttttatcgacttcctctatatcataatattctttttgtctttttgtttggatatatgtctctaataattcctttgaaaaacccagtttccttactttattataaaatcgatacataaattgaactgcatctgtatcttcataatcaatctgtgggagcatccatgcaaataaagcttccattctcttttgtaaatcctcgtttttattttggagttctctatcttgcagattcgattttatctctgactctaaagaagtctgcggaaaatagatccattgaatctctcccttactatcttcataaatatattccggacgaagctctatacaattcagatcaagcatatagtcttctatttcctgaatcatgtttctcatattctgcaaaattttttcacattccttttgagaaaaagctcgttcttttccttgccgttttaatggccgtttaccagtaatatcaaacaaaaggcttttctcttcatctttttctctaagctgtgccgatactagcgtttttaactcgttccttttcagaacttcatattccacagacaaataataatcccatgattcattttccgcatacacgactgactcatcatatgcaggtgtcctatattcaatctgctttagcaaatatgtatgtgtaccctcttttataacctccacaatctatcctccccacaacagcaacacaatcctattatcagattaccgcgaattcccgcttaatttcctaagaagttcttcctcattagttatatcggctttttcttcacatttaaaaatccatccttttatccctgtatattttcgccctcccaaaagaggatttccaagtcgtactgatgcctgaacgagaactttatctcctgagatagaaactttataggaatctaacgaagcaatatttaatctggttgcaattcttttttgcagcctcaaccttgttttgcttatgagctgtccccttctattcttctgaagaaagttcttattcctcagaagaagctgctgcgatttatatgttccatctgccaacttcccgtctgttttccatacatctgccgcttcatccgccaaacgcattgtttcactcttaactactgacatatcaatcaaaaacagtccaaaaaagaattctgcgactacgataattaaaataatcggtacaaccacggaagcttctaccgtcatcattcctttatttcccatatacaatctacctcccagaagcacagcgggaacatgggcgcagtctacccacatcttttaatcttaccgcttttatcgttctttttaatccgctacatcctaaagtcgaatggtaacaatcaccatatgcagtcacaaatattgcggataaagaagaccctttatgaatacacttttcacatgctgcatattttgaggaatgaactatgtcctgtattgctgcattccccgtaatctttaggcaaatgtgcgagcaagatgcatttttatggtataccactccattttctgcaacataaacaatactattatctccagccgcatcataatctcttcgatgttttacatagccggaaaatactcttctttttacagcagtatccttctgaaatcgaataggacgaaaaaaaggaactgataatttcaatgtataaatagctttaacctgtacctcttcttcagatgaaaaagcagattgtactgaaattcctttcctgcctccctctactaaactgtcacaaagagactttgcatcataaatatcaaaaaatacactgctcgcatttcttatactttgtctgccatttgttctgtcacttttatggattccattatcctccttcacctgatttgacttctgatcatcttcctctggtactaaagaaaacatttgctgctttgcacatatctttgcagtctgtgataccgcataatgtacttccgtctctactaagatcatctgtgctaatcctataaagcaagccacggcacataaaaatatcggaaataccaatgacgcttccacagttacagatgcccgacaagaaccaaagcaggatgctctttttctcttatgaaagatccatcttataacccgtgcctggagagacaatttttttcctgaatctttttccgaacattgaacattacacatttcctgaaaggggtcaggtcttaggtattttaaagagagcaccctgcttcacctcctcccgcagagcgtattttaaacacactctatcgacattctttctctatctttattaaaaatatcaataactacattgtttcacaaagtttagtttcacacctccggccgcaagacttcctttccagctataagaaaacagacaattctccatcaaaaatcctggctctttagaagctatattctcctgcataatatccatcatgcgataacacactgttcgagaatttccttttgttagaagaaacagcttcaaataatctttataagatatatttttctttcctttttttacaatctgcttatttcttaactgctctgccattgtttttaacgtaagattccacgttgtcttatcttttatcaacggaacttcgccaccagaaaataatgtgtgtaattccagaagggattctccgtaacttattgccattcttataagtacctgtactgctttcattgtctgcggcattcccataaccccagttatagccgatgccatcgtatttatctgcattttcatctgagtatcttttcctgtaaatatataattatttataaagcgtaatagcagaatataatttgctactctttttagattatctatatctgaattctttccgctaataagatattccacctcatacagaagtgcattgtcctttttatcactacttccataaaaagaaaaacagtcttctatataagaaataatatatctgtcctttgtccacaatgtacctcttccatccatagaaatatccacagaaagtaatgactttatcccctttaagcttgaaaaggatagttcatccatcttatccagcaacctttgctcattatcaaaagaactgcttttcactctttttgacggaagattcgttcctggaatactctgtcttgaaagattctccggatgctcagcggcataaaataatatacctgttctcatcaaaagctgtaatgtttccttaatctccttccagttactacgttcctttaatgtttcctcactcacaggttctatttcgtctgatgctgctttttcgtctgatttcatatcctccacattatctgtatttttatctacatctccttttaagtctgattccgtatcctttttatttgcttcttcttttgtttcttgattcacttcttcatcctgttccttttttatatccgtttctgcgctatctacttcttcctggcattcctttctttctccgtcatttttctttgtatttcttataatatcttccaatacttttgctatttccttttcctcacgatatttcatccactcccggatctcgtgtttcagatacaacccatcttcatccactgccgtcttctctcctgtaacttctaaagaatcgcaatatatatcaaaaaacgaattaccagaaaaatattgattgataaattcttttccatcagtcacgatgtaatctttttgtcgcggatcaagaaaaaacaaatgataatttttaaaaagttctctatcatagttggccataatactttctcctgcaccttttactgcatcttccccaagactactggcactgtaactgattacgccctctacaataaaaaggaaactcatcatcaacaccaaaaacagaagcgacaaaaagattgtaatctgtcctctttcatcaaaatatttatcgtattgaacctgcatttttctgtattgtggagaaaatggatgccaccacacctttaatattcgtctggaaaataatcactaatccaataaggactacgataattaagataacctcaacaacccccattccatcctgtgataacaaaatagattgtaaccgattctttttatatactatattgttctgatgcatctgctccttttttctttttataaatgccatatcaattccctccttttattcagcaaagtacacccatatcctagattatgtttgaaaaatgctttctgcaaaatcttctataaatcaagttatgcagattacaggaatgatttttcaaacacactctaataacatcttctaaaatcaaaatccctgaaagcgagtcagtgccgggtacatcaccaataacattacctgacacaataataaaatcattggaaaaagtaatcttgttgaagcctcctctccctctttttttgctctgtctatccgcttatgaaacgcctctctttcttctgcttccattaacattgctgcttccttgctgcctttcgtaaagctctgaatcaagataagcgaaagcttctgataactgtctgtcctaaactgcattccccagtcctgacatgcctctctctggcttacaccattactcatctgctgttccatccgcatcattttttcaaaagcatattttttagaatcatccaattctctctgcttttgatagttctggctaattcttttcaccgcagaaaaaaaggatagtcccgctcccatatatagagtaagaagatgaacaataaccgggaagtcccgctctgcctgctcctggcactttttcccttcttcttgcaattttaaataattatgtagcgggataaaaatacatacagtgacaaataaaatcaatatgcctgatattcctccttgattttcctgtctttttgtaatttcaatatctttatagacagacggtattttaatatcacgactatatctattctcctgctcctccttctttaaatattgctgtatcttataaaacacatttgtttgagatatatttttcttcggaacaatcccgatctcatactttttacttttccgatattccccgtaccgtgctgttaccacaatatatgttttatatgtttctcctcgctttagctttgcttgttcttcttcatttatcgaaccgtccagacgaatatatccatcttctgcaagttcgtatgtaatctcaaaaggatatccgtctactgtatccggcaggttcagcggggtctgcatctgcttcaatgacgtattatttttcatcattatcttttttaactttttaaagaactgtatatacactttcgactcttcttctgccgataatttctgttcatcaagtttataagttatctcctttttcttgtcatccttttttaaagataactgcacttcttttgatccttgaccaaataaatttcgactcagtaaaatatcatcttgcaaaaaggctgctcttataatcaaaaaagccaaaaaaactgctcctactatgatttctattaatataatcttcttctgcttttttaaaaactgctccttcctttgtctgatctgttcttctgattccgtatactggctctttaaatcgctgattatccggctctctatcttttgtttccatgaaacaaaaatgttattcaaaagttatacacctcctgtttaaaaccgaatattcataattttctccgaccagaaaaaacaaaaaacagtaatcccaatcatacctgacataacgagatggcctaaaatagtgttgtaaaaacacgctacatattcaggattggccaggcgcaaatatagtaaaataaagaatggcattgataacataatgtttttttcaaataactttccacttaaaagaactcttatctcttcctccgtatccatcttatatttcaaatgctgcatcgtcctttttaaaatctctaccatatttcccccggtactacgcacaatctctatcacgaccgcaaactgctttgcctcttctagtcctgtactctctgcaaactccataaagagttgttctaaagcaatatgcagatctaatccctgtatgattcttctcatctgccttaacattggattattctggtcttgatacagctcttctaattcttttagtgcaatcctgcaggaattattcaaagaataccctgcctgcaatgaagtcatcattgattgcagcagattctgaaatcccttctcatataaatgtttttctttctcccttttctttctttttagaacattaaaacacggaaataataatatttgttctaaaagcagccaacgtatatctccataacataaaatattcagtaaaataagacctgcttccacaatcaaaaaggaactaaccctctctcttctcttcacaaaacagtctcaccgcctcacaatagttttcatactgcccatagctcttaagcttttccgtatgaaaaagtttccctgtcatttccaaactttctgtctgtcctgctttatattgaaatagggtacgaatatcatactctgctctactgtaatccttaatttcgcatatctctaatatctttctttttcctgtagtaagtctccctaaatgaatgaggatgtctactgaagaagcaatcagtccctgtattgctgcaagaggcatatccattcccattaaaaccatcgtttctaaacgtcttagcgcatctcgacatgaattggcatgtatcgaagatacagacccactatgcccagttgataatgcctgaagcatcgacatggcttctgccccacgcacttctcctacgataattcgatccggccgcattcgcaaagatgccttaatcaagtcctgcatagtaatctcattctctccctccatgtttgcattcctcgtttctagtcgaacaagattctctacatgaaaaagctggagttctgctgaatcctctatcgtaatcactctttccctcttccctatatattctgcaagtgcattcaaaagagaggatttacctgagtttgtcgctccactaataagaatattgtatctgctctttaccagggcggacagtatacctgtaagtttctctggaaactcttcaaatgctaaaagcttctctatcgtcatgcctccttttagaaacttacgaattgtgataaccggcccttccagtgatactggcggcaatacaatatgtaccctcgaaccgtctggaagtctgctgtccacaataggacaagcctcgttcaccattcggtttgttggtgccacaatctgctctatcaagcggtatacatcgccctcttctgaaaagtgttcttctattcttctaatctttccgttctgctctacaaaaatacgcgaggctccaattaccataatctcacttatactgctgtcacccaaatatttttcaagaacatcaaatcctcttatcgaataaaacatctgtcttcttagttcttctttctcagaaagtgtcccatatccgccatgacttgaacgtaagattgccttatcaatctcacgatatacatctttatcgctgacatatgatgttcttccatccatctggtgtaaaatctgttctctcagctctctctttccaggcagttccatctaaaatatcctccctgtatatcctctgccatatttgaggctcttcctgattaatattcaatacacgttccaaacggtcacaaaaaatactctgcctcggattcttcctcgaatctattaatataatctgatcaaaaaagcgtagcatatctacattggcaacaaaacaatttcccgctccccataatacttccctatagggactctctttcttaatcttatcaaaaaaccatgcataatcctccttcgtcaattcccgcaaataaaaatataagtctggagaatgtaacacctggacttcttctttcggaataagcatatcctgtaatatatctaaaatattctcttcccttaaatgaatgtaatagcataaatctcccatatccccgccttcttcgtattcagaatctatccctttatagcccagatcttccgctcccatatatacatctcccgatgacataaaagaacgtgctatctgctcaagatattcatcatacacaggggaatacacgattgttaacttcgtcggtgtatcttttaactctgctgccaagtctgataaatccgaattataatctgtaaaatcagacaacatatctaacaacttctggggattatcatatttacaaaaagagccttgttcctcccgccaggttagtaaaatcagcttcttctgttttaaaaatttctgtttctcttccgataattctttaaaaaatctttcatctaaaagataaatctctgcctcttctttaaaagaaaccatgccttctgccgttgtaaaatgatatacacgcactgccgatgaaaggtgaatctccaaatacctcaccagccgcttaccatactctcctgcttctcctataatgattgtgcgaatatctgaaaaatccatatcacatccctccattgttttatttaatgtaaatatataacagttattccaaaatcaatatatcacattttccaatttttgtctacctttattttacttaaattacaaattatttatttaaagatatttttcatattttctcttactttttcataaactcataaaaactaatatgccagaacgtatttgaaaatgctttctggcaaagctgcatgctaaggagataatttatgtaccctattcttttttctttttctactcatttttccactttatttattaataattcatccatccagaatatattatcccaggataatctatctcaaaataaaattctgcttattttttgcgcggcctgttttgcaggatattttattgcatacataaaaaaaagacccacagcacttttttccatcatcggacgcggtgccgccggtctttcgttcatttacttttttaactttttctgcgctgcaagagacatcatcactggaattggaattaatccgattacaggcgctgtatgtacagttcttggcattccaggagcaattctgctatatgctataaaaatttatagttttttataattcaccttatcctcttccagcaagaagacttctaactccagagcatatattcaagaatgccccggcatcctacaggtgatgggatgtcactataacacaagccgatagaagtttcctcttatagctgcaaatattttctatctccgcttaattaaataaaccacttaatgctgcaaaaatagaagataatgccgtctttattttctcaaagattccctgtgtatcaatatccatgtcactcaatttatcataaattttacttgcctgttcttttaagtcatttacatttaaatcaagcttattaattttttgcataagttctgcaatctgtgctttctgatcatctgttaccgtaatatctaagtctttgctgcactcatcaataatatcattgatatcactttctgattttacatcatctgaaagaactttttctttaattaacgctaaaaactgttcggctttgtcggaatcattaagctgatcggctaactcactggtaactaccagctcattcgttgcggcatctttgctctcactggaaatatcttcacccgtcatgtcttcatacgcattcattgcaccaactaaagcagcagttcctgtaatattaaaaggtcctgctacagttactgtggcatctgtcacacctgctgttgtaagcgcattttcatacatacctgctgtacagtacgtaatatttttcgttgtaacatcaatgccttctcccttatctcttttttcaaccagaacagaggataaggcctttgtaccaatcacagaagaatctaaataatcatcaagatatttatgttcatccgcattcgtcactgttactatattatactgatcgagtgctttctcatctacgtcaagaagttcaaggactttacttttctgatctgtacttaaatccgcccccagagaaagatatggtttctcctctactgcatctgccgatacatttgcctgaaaggtcataagacctgctatcattattgctgataatgtaataatttttcttttaaacataataaattctccttttactccatatatactctcggactcttcctgcttcggccattccgattttcaaacacgctctagtctaccatatgttttattaaaaatcatttccaaaatctatctttattctttcttttttatatcagctttgtatcggtattttacaaaacaaagaacaataaaaataattgctgttgcaaggcttactttccagccaatagaaaatcctggcggtgtatattttaaggaaactgtgtgctcaccagaaggaacttttactccaagaaaagcatctccgatacgacatgtctttacttctttgccatctacctttactttccatccagaatcatatggaattgacaaaaataatgtctgattatctgaagcatccactgtgccttccagagaattacttgagtaatccgtcaccgtaaatgcctgctctgctgctgtctttttaaaatcttcaaatacctcctgatcgaagtctgccgcagaaaggcgcacataaccatcctcggtctctccttttaactcaaaagttactttaacttctgaacctgcggatacttttccgattggaagcatataaccatctaaatctcctgatttcacattggttccatctaccattatctgtgcattttctacctgtgttccatcataaaacagatacagattctctgccgtctctgtaattggaatggtaaatgtcatattgtccggtcgcgaatcgccatattcaaaataatattctccatcatttgtctttgatgcagtacatccattggttgccggatcgtcaatctcaatatcatgaaacagctcaaatacatcaaatgcctgctctccaagatcattctgtacacggaatggataagcactgtcataataccagtcttttatggaatcattcatgagatatcctatagacattccttttgccggattctcataaatatcaaaagtcccctgtgtcttcagatatttaaaatctgttgtcagagaatcttcctgatgataatacaggtattttacattcaaaaggacgttcgttactggtgttgcacctttataaagatactcattacaccccgtataaaaaccaagattatccatcatattaaccattcggtctgtcgctgtagaaccaaaaagtcccacactgtttattggataccaggcattttcatctaccataagagcactggcaagctcgcttctgtaaaatgtcccatcttttaaagatgcagcagctttctccatatcttctgttccatagaaaaactttgagacagaaatctgaccattttcattaaaacccatacaggctgttgtggcaatctctattattgccactacacaaaatgcagccttataccacacttttctcttacgagataatgtatacaggagtaatatcattccatacaaaataaacagcattcctgccacaccataaactttatcttccagtggctgtgttccttttaccctggcataagctaaaagtcctactcctgccatacaggcaaacgccacatgccagccttttgttccatctaaatgttcaaatacttcccacaacatatgcagaagcacaaaaccaaacaggaatgagaaacgattcggaataccatactgatcatgaaatccatgccagataaagttgagaatcatttcaccaaaactcaaataaaagaatcctactaaaagagttttctttatcttatcactaattttaatctgctggttcaacaaatataatccaactgctaatacggtaaaaataccaatatacagattggcatttccatcaaaattatcatgactgatcggacttcccatcgcaaactggcgatttagcaggtctgccgcattcgtaagaaagctgtgatccggtagtgtcattgcttctcctgatgccgtctgtttaattccaagatatgctggaatgagtaatactgccgccattcctgctgcaaggaaagaatatagtgcaaatgaaattccccggaaaaagaactgttttacacttttaaaggaataaaaaatataccatattattgcaaaaatacaaatcataaatgcaatgtaataattacagtacaacgcataaaacaacgcaagacaatatagccttccgtcctttttatcaatcaaacgctccagccccataacaacaattgggaaaatcataatcgcatccagccacataacattccagcaatagccaaccatgtagcttgataatgcatacgccatcgaaatcatgagtacatgaagcccctgtttcttgctttttgaagaaaaataaatcccggccgtcattccactaagtgcaattttcaatacgataatcatactaactgccatattgagctgcgttttcttaaaaaatataatcaaaagattaagcggactggataaataataggaaaataatgataaaaagttaattcctaatccagaacggaaactgtaaaaaagactttctccgccttttaacttatcatacaaaacagaataaaatggcatatactgatgtaaaccgtcaataatcaacagcgaattatcaccaaatggctgtataccaaaggcaatacagcagccagtcatgacaataagcggcatgaaaaaagacagtgcaataacatgctttctaccaaatctctggccaatatgccttatctgtttcccttctttttttatattcatatgctcctttctcatcctccctttttcagatttccagagtgtgtttaaaaaagtaaaagtaatctgcatatcccgatttgtcagggattttgccaagcgcatcaaacactctctaagcttttacttttctcactcgcttctttaataatcccaggcagcgtattatatcaattctcttttttatcataaaacggatacttccatgtgtcatctgtgtaacattagacgaatgcctgcgatagccaataagtggttcgtccaaaaagcaaacctttcccatatactctgccgctgttccaatccaatagtcatgcatatacatttcatttggaataggacaaataatgggaatcaattctttgcgaaatgccatgcaacatcccacatagctgtttttcagaagatttttcaaaatcccagcccggcttccccttatagaaaaaaggcttgccgctcctgttgctacaccattctcgtccacaatctctgcatcatgaagaacagcttttacttctggatttgaaaatgcataattcactttctcgactttatctggcttccatatgtcatcctgatcagacaaatatataatatctccattacaatgccggatcgcattctcaaaattccttacaacacccttgcccggtcccttcacaatatgaattcgggaatccacttctgacatctttaaaagaaggggctttgatccatcacttgctccatcaacagatactatcacttcatccttttccccaagttgtgataaaatcgaatccatctgttcttctatatatgtaccaccgttataatatgccatagccactgaaatcttcatacacatatttctccaatcgtaaatattacaaaattatatcttcttcctgttttttcttctctgctgctagaatacgctgtttttcctcttctgacaagttctcatctttcaggattttagcataattttttgtacttcttgttaaattatttcctaaaaatattttttcaacctgtccatccattcttccaatcacaacacccattacattttcctccttgcccccgcaaaacatatctatatttttcaatctgtttcaccttttgttcaaattttcttcaaaaatcggacatactttttctttatagtatagacagcaacaaagaaatccctctatttcttgtggctaaagatttttttcatattttgaagcccgtatatcaggatatatgggcttcctccttttaatgaatgcctctaagcgaggctaagaaagaactctttccccggagttctttctttttctgagcactccgcccactcttcctgtctcttctgctgtaagtgaaccccaacccttttctaaaactttgtcatagattccaagctcttttgcaacctcatattttttctgaacatccgcatcaagctctgaaagattaatttctccccctaaaaataatttttccttctttttcacaaaaaacacctctgctttcaaagattatcttttgcaaaaaagaaggattctattcttaatatattatttttcagatttaccagctatataattaataaactgctgtgcggtacggccggagattccaccatgagaaagttcccatttgttggcttctgcacaaagttctttgtcgcttaacttgatttccggatacttctttgcaagatttgttacaatctggaagtattcctgctgtgttggtttggagtagttgatacttacaccaaaacgtgctgccagtgataacttctcctgtaccgtatcagaacgatgcagttcttcgtccttgtcggaacggtctgaccatgtctcacggatgagatgacggcggttagatgttgcgtagataagtacgttatctggttttgtctccattccaccttcaataactgctttcaggtatttgtattcgatctcaaattcttcgaaagataagtcatccatgtaaatgataaaacggtagtttctgttcttgatatggctgataatcgcagaaagatatttaaactgatgtttataaatctcaatcatacgaagtccgtcaccataatactggttaagaattgccttgatgcttgtggacttacctgtaccggcatcaccataaagaagacagttgttcgctactttaccctgtacaaatgcttctgtgttatctacaagtttctttttctgaatctcatatcctgtaagatcatcaagcacaaccttgtccagattattgatcggaacaaagtccggctttccattattctctacgatacggaacgctttgttaagtccaaacattcctacaccgtaatctttatagaacttcacaactgcattgaagaatgtatctacatcttctgccgctgccagttcatcagaaagggcacgtactttttcacttacatttttattatacattcgctctgtcttgccgattgccttataatctaaaattgtgctgaaacaatcaatacctaatgtctcctcgatcggtctgaagtcataatggaaaagattcataaatacctggaaatcattctttgcaaagtgattgactgttccattatttgctccgactttctcgcttgtcatgctgaaagaattttcattggttactaagacaaatgtcaggtaattgtgccataagttcttgtcaaatccatatgtagtcgcaagatctaaaagcgctttcatttctctgtaaatgtctgtgattaattcgtcagctctgtaatggcagctatcgaatctcttaaaaatatctgccatatttaaaagaatactgtcttctcctaaatcccgatataaaattaatttggatacttctctgtacattatctattcctcctgattctcagaacggtttttcaaaatttcgtctacgtttaatgcttctatctgagaagcaaactgactcttcaactgttctattttatctttcgcctgttcccggtcaccgtcaaatgcagtataacctttgtaagaagctaccatcggtttttcttcctcatcttcagacgcatccctattagaatacaactctaagcccggaaatgcaaacttgggtttatcttcatcgtgaatattgccattacggatgtcttcaagtgttaccagacctggaaatgcatgctttggtcggtaatctggcatcttaaatacttcaaaacagtctaaaatatctacatctgtcatatcatcaggaagattctcctttaaatattctggatgatgctgtttataaaattcatagataacctgttttaccttcgggtcatgaatatctgtgtccacacgttcgtcattaataaaaagataatatctgtccacatatggaagaattctctcttctgctgtaatagacgttatttccggtacactgtcataggaaacttccagacggcgaaaagttctctgtttctccttcgtctgagtaaccccttctattttatatttatccagttcaaaaaacatgctttttagcaacgtaaattcatacataatttatctcccaatactctgttattttttaatatattaaatgcttacctctaaatatactgcctcattatccccaaaaaattccttgataaaaagcctgcattccaagacataatttatatggcattttttatatttattttcttactataccacaattacagcatctcttccatctcgtcaagaagctcgccaaataactttaatgcagattctatcggttcctttgcagccatatctacattacaaagacgaagtaaatcaattggattcatggaacttccaccacttaagaacttaaagtagccctcttttgccctttcatctccacttaaaatctttctgctgattgcaatcgctgctgaataaccagttgcatattgatatacataaaatggtgtatagaaatgtgggattcttgcccattctaaggcaatttctttatcaataacaatgtcttctccaaaatatttctgattcagtttatagtaaatgtcacataatacttccgcagtaagcggctctttattccatgccatctcatgtgtaattttctcaaattctgcaaacatggtctgacggtataatgttcccttaaactgctctaagaaataattgatcagatacattttctcttttttctcttctgtattctttaaaagatattccatcaaaagagcctcgttacatgtagatgctacttccgcaacaaagatacgatatcctgcgtaaatgtatggctgattcttatctgaataataagaatgcatggaatgtcccatttcatgagcaagcgtaaacacattattcagattatcctgatagttcatcaatacaaatggatggcatccgtaagctccccaggaataggctccgcttctctttccctcattctcatatacatcaatccagccactttccattccatcagaaagaactttaccgtattcctttcctaatggtgcaagccctttctttacgatttcttttgccttagaaaatggtactttcatctcaaattcatcgaccattggtgcatagaggtcatacatatgcagttcttctgcctttaatgctttctttctaagagaaacatagcgatgcattaaatccatatgctcatgtactgtatcaatcaggttcgtgtatacagaagttggtatctccccaccttctaatgccatttctaaagaagaattataatgtcttttctttgcgaaaaatgcagtattcttcaaattcgctgcatagagcgccgctaaagtatttctatattgtccatactgtgagtaaactgactcaaaggcacttttacgaatattcacatctctgctttctaaaagaagcgtatatcttccatgacttactggaattttttctccttcttttccctcaatagatggaaaacggatatctgcattattgaacatagaaaaaatattggatacatcggcagacatatcggacacatcagcaagaatcgcttcctcttctttagaaagaacatgcttctgctggcggaacaattcgtaaaaatatcttttgtataattgcatatccatgttttgtgtaaaccagctatctatcgtctttttcccaattgcaagaagttctggttcctcaaatactacagcactgtctaactggatggataatgtctgcgccttacctgcaagtccctggtaaaaactatttcctgtgtcctcgtgataacgctgatttgcataaacataaatcgcctcaaactttttcataagcgcttcttttttacgcatatactccacaaatacttcagaaccttcttttaaacgtccctcatatgctgcaaggctttgaatctcactcgtaagactttcataatctttctcccacgcttcgtcagaagcatataaatcctgaatatgccactggtaggccggatcacattcctgtcttttctttactgttttttctttgttctcttccatgatctcattctcctatatcacttttctttacactgcatctattatttatatgtatttttatgtaatccataccgtttatttttctgttatttcgcttttacgctgtcttttgaacttgtcttatcccattttgcatgcaaaataagattctttgtatttccctttggaattactgttacattttttcctgagctatcgtaccagccaacaaaagtataacctttttttcgcggacttcgcaatgtaactgctctctttccagataacctctctctattcttggaagagttaattcctacgttcttataagtaatcgtgtagccagaaacttttacacgaaaagctctttttcttccattaattctggtagaaatatatgtctttccgctcctctttgctttcatatatccattattatcaatacttacaattgatggatttgcacttgtccagcctgctgtcctaagccctctgtcatgcatatgaatcgttgcaagctgctttatttgtcctgcctgcagctgtatgatcttgcgaccactctttgtaagctgaccagattgctgtgcccttccgagaaaaatctttacatttcctctcctgacaccatgaaagtctgtcgtataataggaaagccagccattcttattcacaatgaatcttccaatataaataagactccataatgctccctttgtctccgcatttttatcccgattatctacctttttcagtaaaacaggatatttatttaaaaagctcattcgatagatgccagaattcaatgacagaataatccgattgttatactgccgaatccaccctatataattacccgaccttggcgcataaaatacaaccgctttatttcctctcaaattcgactttttcagataattatcctgagaaatccagtaccagtatcccttatgatagaatgtacatgttttattctcaagcgcctgcttcatctcttttgaattctttatataatcagaagatgccagtttaatcttccgcatcttcagattatttgaattgccctgtccatatagatccttcttcttgtatccaggatgggtctttagaaaagtattctttcccacaagaaaactatcataagtcactaccattccctcatgcttgccgactcccacaccattggtcaaatcaacaaaataccagattccattaagctttactatattccaggaatggttttttgaataattactgataaccgcacatggtattccaagcgtattcatcgcaagagcataagcattagctaaaccgtcacacacacccacatgacttactaacacatcatatcctgtgtgtgcatcttttgactctttatacgtcgtgttctccgcaaaataaatatacaccgccatcgctttatctgcctggctcatagaagaatctacggttgacaatgcctcatccagccctcgtataatcttcttataccttctgcgaaacttactgcggcttatgagcttcgtactgttaaatgttgtcgctccatctctcgtttctactgcataatactgtgaccagttagaatcaagaaaatctattccctcagccataagcgctgccctgtttgaaatagctgccgcttccatacacttcttaccagattttccctggctcaccgttcggtaaacatcaagatttcccgaaaccgttccctctatcataaactttgacagcacattaatatattctttttgcgtatctgaaaatgtcgctgcatctacatcttttgtgaaaaaaaggcttcccgccaaaataaaacaaagcaaaaatagaatacttcctgcccttttcaattctctacttaaccctcttctctccttcaatatttccctccatgaaaaactcggtacctgaattatcgagattcctgcttaatttctaaaaaatgttatgtactcccaaaatctttttatgtttaattttataagaaatttttgttaattgcacccaaattttatttatcccttaattttctttctatagtccatgacaatccccaaaatacatttttcaagaatgcccactgatactgatttgttgctcgccacctacagatgtgggaatcatctcacatctgatataactattagaatatattttatactctgtcttaatcttatcattatacagaaaaaatagcaattattgtcgaaacatgataaactatatccatgtaatttactattaaatactggagcgtgcatatcctttttgatttctcaaacacgctctggactggaggattattttatgacaaaaacatctgaattccataccttactccgcaactatcgcggcattatgggaaatatacgaatcaacaaaatctggatttctttcgactcctgcttctttaattattatgcagatgatgatgaaatccagttcaaccttgcaggacaggaaggtgttattaccattcctgctgtcatttcctacgacaaaatcgatgaagaagatttattcgaagactctgtagcagggtatactgcaacattagaatctggggacaccgtgactttctactgttttaatgcaaaaaataaaagctgatttgtgggatgagagaaacaaacagatagtattcatctgtttgtttttctccttttattatattgtaatcctctgcagttctttaaggacagtctgcaccctctcttcgtctacatcataactgaccacacataatgccttatacaataagcttatgttttcttctgtgctgtttattgtataagataccattccagaagcgatttcatgacttacattcaaaagctgaaactttaaatcccgtacagtctcacttataccagacgcttgcagctcatccaggttatactcgtctgtattgccgcaaggcgcaaaacaggtggcacaatctggggctaccgcaagcttttcttcacggacacgttgtaataattcttcgccattctcctctaaaggaaatattgacgcaagactctttataataataccatctgtattctctgtttttaagtgaacattacatgctttcgcaagtccgatcaatgctccgataagttccttttcttttttattcatctataacatccccttacccgcttcctgcaaaattattataaaaatatgcacgccacattataccagcctggcaaaatatgacgtgcattatatattttatctgtctgtattctttgtaaaatatcgtaaaagcactttaaatcgtgtttgaaaaatattttagtgaattgctgttccttctggtacgcagtcatcaacaaagataatcttacatccaaaatcatctccgctggctgcaataagcataccgttgctcttcactccagcaaacttcgctggttttaagttagcgattacgataatctttcttccgataagttcttctggtgtgtagtcatcacggatagatgatacaataactctctcatctaatccatcaaacaatgtgagttttaagagtttcttagcattctttacaatctcacagttgataactttacaaacacgcatgtctactttatcaaactcatcaattgtaatctcttctttgattggtgcgattgcattcttacgagcttcctcttcctcggcagcctttcttcttgcttcttcttcagcagcttttctctctgcctcagcctttgcttctgctgcaagagtcttctcttcctctgtctgtggagtggaaaaatcaagaagtccaagatatctctgtggctctacagcaaacaggaataagtaaagtcttgggcctgctgccttaccaatcataaggttatatgcattcttgaagaactgtgcctgtgcagtcttcttattctcttcctggaagtctgggtctgcttctcttggaatcgtgtaaataaaactattaagagcatctaaatcatactctcccttagcaataaagtcatgaagtaactgaatctccttcttctctacttcattcaaagtgttatagaaatcccagtttctatatccaagaagagtattcatgttctcaggagaacacttctctaaccagtattttgcaagttcaagacgctctgcaaactcctctttcttatatggagtaccaatcttctcgaatactgtctccagcatatctgcattaaagtctacaacagaaccaaagtttacaatctgctgcattggtactggataaagctcacggccttcaatcatacagttatgcatgataccttcgatataatcgtagttcttacccttacctgcctgatataccttgagcatcttatcaaactcaaaatactgacgtaaaatctcatcatcaaaacagaaatcaaatgccttgtttggttctgacttagagtaaagccataaaatcatttctggctgataaatcttaagtaatgtatctggtgtaaggttaagacctgtagaaccagacatcttacctgttgttcccttaatacctacaaactcgtatcccttgaacataggagcctgtgctccgaaaatcttcttagcaataatcttacttgtatcgtaacttcctcctgggctggcatgatcctttccgcccggctcaaagtcaacgccttcaatcatccaacgcataggccagtcaatcttccatgcaagcttacagttaaagtccttgctgaaatcccatgttcccttatgtccgcacttacatgtgtactcacaagttactccatcttcagaagaggacgtgatagtagtctcatccttaccacataccgggcagtaaatacttactggataatatgcttctctttcttctggtgttgcaacctgctgacggaacttatcaagaatatcaaaaatctcacgtctcttctgtacagcctgaataacatacttcgcatacttaccgctgcggtagttctcgctctgtctgcggaagtcaacctttactccaaaacgtgaaagagatgcttcgaactctttctcaaaatgttctgcataagaagaacagcatccatatggatccttaacgtctacatatggcttaccaatctcgttctctaattctggtgctacttctttaacattaacaggtacttttctgaaacggtcaaactcatcccatgaaaacaacagacgagccttcttgccctgtttaattaaagccttatatacaaaataacttgttgctatatctctaaaattaccgatgtgaatggatccggatgggctaatacccgctgcacaaacgtactcttccttgtccggagatctcttaataatatcctttgcaatcttctcagaccaatgcattcttcttcctcctactttccctgtgccgtacttaccggcattcaaacagtgtatctatcttcatttatcatgggacttaaaatttttcctcagcccatagtcaataaaacattatatcaaaccctatacctcttttcaaggaaaatctcatatattcaatctttttcgactctttatccttatgtaaagtccccggtagttgaattgccagggattcccgcttaatctcttaatccagtttctatcattgtccccatctctgttcatcttagaaaaatattatatacgcaatcttcctccaaatataatttaaattctaatagcctggcaattcatctcccaccttagaggtcggagtcttcttgctgtaagaggataaaatgtccaaataccacattacttgcttcttgtcccctcaatatatttcaaaaaacggatacaatctgctattccacaaaaataactctctgtcgcatactctgcctccgctgcactctgagcctcaaaagcctcttcaataacctccctctgctcctctgtcagattcagcgtgtccagcttcgcataggcttcctcttcttctctcaccaaacgcctgtatgcttcggaattcttacgaaaatccgccatattctcattacgaaaatggtctaaagtaagccgaagtctctcttcccatgaatctataacatctccctgcaatgtttcccgcctttctacttaagacacaatcccaataaacctctactaattattaaataaatttatgaacatagcaacagcataacacagcctttgttctgtgtcaatattttcctttaaataattatttttacttataattacttaattagtaaactacatccatcctcattcccaaatatttttccccttttttattatttaattcattagacagatgcccgagagaaccaatccccctattcccagtcattctcgagtaagcagaatacatcagcttccatccccaaatctcctcccactatttaattcaccttctccagccacaccacaaatatgccttattggggcaatggcttcgtctgttgtttctccaatgaattaaatagcaaaaaaccattgacttaactggaaaaatcctgtatactgatatttaccgtgcagctgggaagttagcggcgtcctgtacctgaaatccgctatagcaggagtgatggtcagcctcggatgtcttattgatggagctgccctttataagtggtgttgacaattgggtctcgcgcaacaggaacctctgaaccgtgtcaggtcgggaacggagcagcactaaggagtctctcctgtgtgccgtgagggtgcctggttcgagctaactgtagaggtaacgtctgttggtaagcatacaaagctgaccgcacggttttaataattcgatttttatattcacataatagaaagcgtcataataatgaagattgttatatatctttattgctatgacgcttttttattcaagaatgcctccgcattcttgctgagagatttgtgttatacaatgcatagcatacttttacatgttactagttattatctctttaggaaatcaggcaggaatcctcgttcacttaatcgccgagtactttactgattattcgtttcaaacttacaattttataaaagaagcacaaagccagtctcgcaaccagctttgtgctgcattttaattctaattatcagtctgattttcttcctgtatcagctttcgctttttctttttttctttttgaatttctcttaattttctaaaaaatgctgagagcatttccgagcattcttcttgaagaacgcctctttctacctctgcctggtgattaaattcctgcatttcaagaagattaagtattgagccgccacaaccagctttcgcattcatgctgccaataacgactctcgtcactctcgcctgcacaattgctccggcacacatctggcaaggctccaaagtgatgtacatcgtacagtcttccaatcgccagtctccaagctttttacatgcttttttcatcgcaagaagttctgcatgtgcaagcacagtcttatccttattccgcttattatatcctctggcaattatttttccatcatgaacaataacacagccaattggcacatcaccaatcgcctctgctttttttgcctgcttaattgcctctttcataaatttttcgtcttctgtatattttctcataaaatattctcccatttatgaaactcatagtcccgtaaaatagcgacgtacttatttcaatattttgtgataccctcctgcctacagatgggagcttcccttcccccaataaaatcaccataatcacatcaaaaaatacatttgcaataatctgccaaactgtcgatttatattccgtctctcagcagatacaaccagtatccaaaacttccagttttcatacgattctctgtaagtgataaaaatactggaaactgataaatttctgccatatatttttcccgattctcataaattcccggcacaccgatacagtagcgttcttctcctgcgtaccttacttttcctgccagaatatgatgatatctcccatatcctttcaaaaggaactgattgcttttaagtacgctggcttcttccccaaactgtgccaaatccgcggttgaaatcctgcatccttcataaaaagcggtattaaaaatattgtccacagaagggttctttttcattgcatttatccacattttttcaaaattatcaacaacagaagtggcttctggctcagtttctgcttctatttttatttggggttctatttcggagtcaatcttcaactctgattttgattccatttcagcatcagtctttaactctgattttgattctatttcagaatctgtcttcaactctgattttgattccatttcagcatcagtctttaactctgattttgattctatttcagaatctgtcttcaactctgattttgattctatttcagaatctgtctttaactctgattttagttctagttcagatttattttttgattcaataccatcttctgaaaattcttttattttaacactttcttctatatttgtattattgctatgtgctatatcattttctgaatcaggcaagttttcctctgattttatgttctctatcttattctcagctctcttttgaaaatccttttcctcaaaactctctgtgtttatctgaccttttttttctaaaatattttcctctaattcttgttgctcctgtaacatttcatcagtaatatttcttgttgatactttttgtttttctgacatcttatctggaagaatcttttctgtctctgtctgtttttctgatattttaccagcaatatcttttccagatttattttcctgcatttgagatttatcttttgcagaattcacaatcttatgccaccgaagaggctccaaagtttctgtcggaatttcctctccaatccatacacttccgtaataaaaagcatcctgataataaagtaatactcccgactgtccttttatccgaaaaccagccggaagcatagctgcagggtaggtcaaatgtatttcttccttatgttcttgcgtaatgagtgtgtctaactgccagacttgccagctttctccctgccgctcataaaaacataatttaagctccattccctgcaataaacgctcatcgtctatctgaatcgtcagtttaaggctgcctgacttttgttctgccttaacaaacccgaagcattcctttttctctgccttttcataacgatacaaataagaaagtatcctttgataatctgccatgatgatactccttttttcactaatgtattctacagaatgacttttatgccaccaaatatcctgtaaaaatataccgcaaattgggacgtgcagattgcaggaataatttttcaaacacgctcttatcttccaagaatatccgataactttgcaaactcctctaaagaaagcttttctccacgaattgtcggagtaagtcccatctcttcaagcgccgctactgtcttttcctttggaatacgaagttcgcttgaattataaagtccgttctgcagcgtttttcttctctgattaaaagaagcacgaataatcttaaacataaatgcggaatcatttaccttaactggtttttcctgataacgagttaaacggataactgcagaaccaaccgcaggtcttggaataaagcagtttggcggtacatttgccacgatatatggttctgcataatactgtactgctaaagaaagagcaccataatcctttgttcccgggcctacctgcatacggtcagcgacttctttctgcaccataactgtaatagagtccagtggtacttcactctcaaataaccccataataattggtgttgtaatatagtaaggcaggttcgcaacgactttaattggttttccaccattcttttcttctgcaatcttgcgaatatctacctttaaaatatcttcgttcaatactgtaacgttatcatattcctttaaagtatcctccagaattggaatcagctttgtatcaatctctaccgcaacaacttcccttgccgcctccgcaagatactgcgtcatcgttccaattcccggtccgatttctaaaacaaaatcatcctttccaatctctgctgcaccaataattttatcgagtacatgcgtatcaatcaaaaagttctgtccatattttttctgaaaattaaatccataccgctgtaaaactgcaatcgtttcctgcgggtttcctaaattcgccataagacctccttgggctgtcataagattttgaaagcaattttatatttggggaatcaatgttgaagtcttccccttaaatttttacttagtttctctataataagataataatacatgaaatggatatctcattcaagagacgaaatcaagaaagggacaatatgtaaaagagaaagaatccatatctgtggcctgggagcaagtgttggatgcgagcggctaagcgaacattcaacacgccgcgacgaaagtcacagatatggattctttctcttccagagttcgtctgtccttctgttctcctaatgaattaacccatacaatctctgagcattttcataggttacattttctacttcttccgctgtaatttccttaagtcttgcgatttcttcaatcaccagcggcagatatgcagagctatttcgctttcctctgtgtggtgctggtgcaaggtaagggcagtcggtttctactacaatacactctaatggaattgcctttacaacttccttcagcacacgggaatttttaaaggtaacgacacctcctacaccaatgtaataacccatttttacatattcttttgccatttcagcagaaccggaaaagcaatgaattacaccgcctgtcgttccggcgtgttcctttttcataatgtcaaatgtatcctgcgatgcgtctctgctatgtataattacaggaagtttttcctctgttgcaagatgaagctgtctgataagccactcctgctgtacttcttttggctctacattccagtgataatcaagaccaatctctccgactgccacgattttatccctgtgacaatattcccgaagctgctccatccgttcctcattaagttcaccaacatggtctggatgaattccggctgcaccgtacataaaaggtactttcgaaataagttctaaggtatccatcaggtctttccagcttgcactgacattgacaacctgtgtcacgccagcatcttttagcgattcgagaacgaccgctctatctgcatcaaactgtttatcattataatgagaatgtgtatcaaaaatcatagtatacctctttaatccctggtttgccacagggaaaatagacgctcccgaagagagaagataccctatagctgtgaccttagaccaagggttggatgcgagcgtttaagcgaacattcaacctgcagcgacgaaagtcacaaatatagggtattgcctctcttcgggagcgtctcccctgcctgcggcaactcagaatttaattaacaaatctctgcgcctgctggcatcttcttctctggtaccatcagggataattccccattttcgtcctctgcgcataagagcataccttcagaaagtacaccggctaatttcgcaggttttaagtttacaagaaccataaccttcttaccaaccatttcttctgcgctataatgtttcttaataccggaaacaatctgttttacctggctgccaatcttaacctgggagcagagaagctttttagacttctttacttcttcgcaggcaatgatttcaccaacctggaactgcattttttcgaaatcatcaaatgtgatttcttcttttggttcgatgtcgattactggttcgtcatcttttttctcttcttcagctggagcctgtcttgaagcattcatctcgtctacttttgcctgtacttcttttgcatcaagtcttgcaaaaaggatttctggcttgtctgttactttctttccagattcgtaaagaccgaacatttcaagttcgtccatagttctttcggaagaattaagctgtgcaaaaattctttctgccgtttctggcataaatggagaaagtaaagaagcaccgattgtaatgctttctactaaattgtaaagaactgtagcaagtctgtcctgttttgcaggatcttttgctaaagcccatggcattgtctcatcaatgtacttgttacaacgtttaaataagttaaagatttctgtcatagcatctgcaactctgagcttagacatacattttattactttatgctttgtatctaatgctacgtccataagattcttatcaaatccatctgtcactccactgttagctacaactccgccaaagtatttattagacatggaaattgtacggtttacaaggtttccaagtgtattggcaaggtcagaattcatacgttctactaagagatcccatgtgattacaccatcgttctcaaatggcatctcgtgaagtacaaagtaacgaacagcatctacaccgaataaatctacgaggtcatctgcgtaaattacattacctttggatttactcatcttgccgtcaccctgtaataaccaaggatgtccaaatacctgttttggaagtggaagatctaatgccattaaaaagattggccagtaaattgtatggaaacgtataatatctttaccgatcagatgtaagtctgctggccagtatttcttaaataattctccactttcaccatcgcagtcatatccaaggcctgtgatatagtttgttaatgcatcaagccatacataaacaacgtgctttggatcaaagtctacaggaataccccatgagaaagaagtacgggatacacataagtcctgaagtcctggtaaaaggaagttgttcatcatctcgttcttacgggattctggctgaataaaatcagggttatcattaatatactgaatcagacggtcagcgtatttgctcatacggaagaaataagcctcttcctttgcaggctggcatggacggccacagtctggacacttgccatctactaactgagattctgtgaagaaagattcacatggtgtacagtacattccttcataatgtcccttgtaaatgtcacccttatcgtaaagcttcttaaagatcttctgaacctgtttttcgtgatcctcatctgttgtacggataaacttatcgtaagatgtgttcattaaatcccagattctcttgatttctcctgctgtgttatcaacaaattcctttggagaaattccagcttctgctgcctttaactcgattttctgaccatgttcatctgttcctgtctggaaacgtacatcatagccttcttttctcttaaatcttgcaattgcatctgctaaaacaatctcatatgtgttaccaatatgaggtttgccggatgtgtaagcaattgcagttgtaatgtaatatggtttcttactcatttatctattatacctcctatgcaacctgtgtcattaggtctgttatctgttcgtcaactttccttaatgtacccttagaatcttttatccctgatttatacagcaattgtatttacagggtaattttgcgcgtacatattattatagaataaatccgaatattcgtctatggttatttttctgaaaaactaatagttttcctgtataattcatagtataataccaaatactttttatcttccgatataaaaatgctatcaaaggaggccgactatgaagaaaaatcatcgcagaccattgtctaaagcactatttacccacttgttttttctacttcttatccttatttgcggagtcagtttagcaggttgtggacaatccagtgcacataattcttcaaagcagaaaaaatttgaccagtttcttgattcctgctttaaagaattcgctaccgaaaacacaattactttgcattttaaactctctgatccgtcttcttacggtattaaaaaggaaccctctcccacttatggagagctttcttcgaatacggcaaagaaaaactgcaaacgttcaaaacaacttcttcaagaactttatacttttccaacaagcagcctgacaaaagaacagaaacttacctggcagatttttcaggattatctaaatgaaactattatgagtgaaaaatatattctttattcttctcctttcggtgcagatggattaccttcggatattcctgtaactctttccgaatatcgttttgacaacgaaaaagatattaaagattatttatcacttgtaaatcaaattccagaactttttacgcaggttcttgattttgaggaagagcgccgtaacgcagatattgtaagccctgattttgtaatctctgatactatcgaccagattaaccaatttttaaatgcaagcgaagaaaataatcttctcgttgaaagttttgaggaacgtctggattcccttgatactttaagtgaagatcagaaagcaagctacaccgcaaataaccgattactcattacaaataaagtatttcccgcatatgagcatttaaaaactgctttacaggtctctacaggcagcaaacatactacatctgataacagcacaaaagagagactctgcgaatatgaaaatggccaggactactatcgttttcttctccagtccgatgtcggaacagacatgtccccggaagaatgtatcacagctttggaaacacagttaaaagatacgataaaagatatttcttccctgacaacacaaaataaagacctgtatacagaatatctcagtgcggttccgacactttcaaaaccaaaggaaatcatggagcagttaaaagacgattctcttgtggatttcccggaaataaagaacatttcttatgaattaaaaaatgttcctaacgctctttccggcacttccgcctgtgcattttatcttgtacctccaattgacagtaaaaatgcaaatattatttacatcaataacaaccgtgtggagtccaacgaaatgttttccacacttgcccatgaaggctatccgggacatttataccagacgaattattttttaagtacgaatccttcccctctccgtacatttcttcactgtgacggatatgacgaaggatgggggacttatgcccagttatacagctataattttacagaatttaaagatgtcgatgaaaaaacacaggcacagctccgccagctatatcgggataatgacctgctctcactctccctgtcctctctgagcgatttatatgtaaattataaaaattatgatgaaaatgcactggccgattatttaaagacttacggaattgataaatccgctacaaaacaactttaccaatacgttattgaaaatccggctacttatctttcttacagtattggatattatgaattaaacaaattagaaaaggagatggctgcctctcttggaaaatcatttaaaatttctgattttcatgaagcagttctgaatgttggttcttgcaattttgcaattttaaggcaggaaatagaaaaggaaacagaaattctcagcaaggtcccttaaaaatattgcttgtatacacgcgttttttaaatattttaaatatttttactcataattggtcattttatttgttttgaataattgacatttcaatcctgcattgttatactagagcgtgtttgaaaaaataatagaatttcattattggggatttttattcttttttcattggaaaatcgacacaaaaagtgtacaatagacaacgtacgcgataaaaagtacaacagtttaatttaaatacaacttaggaggtaatactatggaaacatatggtatcgaaaaacttgggattgtgaatcctaaagcagtttaccgcaatttaacacctgcacagttaacagaggcagctttaagaagaggcgagggcaagctttctaacactggtgcactcgttgtaactacaggtaaatatacaggacgttctcctaaagataaatttatcgttgatactccttctgttcatgatgacattgcatggggaagcgttaacgttcctatcactcaggagaagttcaatgcaattcgttctaaagtaatcgcttaccttcagaacagagaaatcttcatctttgatggtatggctggtgctgatcctgtctgcacaagaaagttccgtatcattaacgaattagcaagccagaaccttttcattcatgaactcttaattcgtcctacagcagaagaattagagaactatggcgaagctgatttcactatcttcgttgcacctggattcaaatgtattccagaaatcgacggaactcattctgaagcagctatcatcgttgactacgaacagaaacaggtagttatctgtggttcccagtactcaggagagattaagaagtctgtattctctgtaatgaacttcttaatgccaaaagaaggtgtacttccaatgcactgctccgctaacatggatccagaaactcatgagacagctgtattcttcggtttatctggaacaggtaagactactctttctgcagaccctaaccgtaaattaatcggtgatgacgaacacggctggtctgacagaggtatcttcaacttcgaaggcggatgctacgctaaatgtattaacttaagcgcagagaacgaaccggaaatctacaacgctatcaagttcggaagccttgtagagaacgttatcatggatgacgaaactcgcgaatttgactttgatgatggatctcttacagagaatactcgtgtaggatacccagttgattatatttccaacgcacagattcctggtgttggcggaatccctaaagtagttatcttcttaactgctgatgcattcggtgtacttcctccaatctccagattagatgagaacgcagctatgtaccacttcgtaacaggattcacatccaaacttgctggtacagaacgtggaatcacagaaccacagccaacattctccacattattcggtgaaccattcatgccaatggatccatccgtatacgctaacatgctcggagaaagaattgaaaaatacaacactaaagtatatcttgttaacacaggatggacaggtggcccttacggagtaggcaaccgtatgaagttaaaatacactcgtgcaatggtaactgcagcattaaacggaacatttgatgacgtagagtacaaacatgatgaagtatttaacgtagacattcctcagacatgtcctaacgtaccttctgaaatcatgaaccctcgtgacacatgggaagataaagctgcttacgatgcacaggctaagaagcttgctaagatgttccaggataactttactaagaaatatcctaatatgcctaagaatattgctgaggcaggaccaaaggctgattaataattcttaggctaacagacaccccagaagaaataattaaggcacagatgtgaagataatcgctgcgaggaaaatacctgtttggtattttctcttgctccgacatcacatctgtgccttaattatttcttctggggctgttacgctatcgccctacaaccccatacttatagctaatatcttttactgccagcaaagaatcaactatttaatacgtaatgactttactgtctctgttcctttattcggcacaaatttaaaatagtaattctttttcgcttttaatgcttttcctttaaacttggatacagtgattgactttccagcttttactgtctttacttttttgtatccaccgtttttcttaagagacatatagactgtgtacttactgattcctgcaacctttggtgtagtaatctttgctttctttgtctttcctacctgttttaacttatactgtgctgttgagaaatatacagaattagaccatggagtatatggatcataggaatctgtatcatagtttatcttcattcctctgactctgaaagaatacagtttattcttactaagctcaacaaagaaatatccaatttctctttgtgaaaaaacttcttttcccttattatctcttacctgtacttcaaattcttcatcctgagtatccttgcactcaatactaacatactcatctgtgagttcttcgatatacccataaactccctttgatgtccttgcctgctttgttgcagcatttgccggaatctgtaaggtaaatattattacaaatgctaatgcgagcgcaaaaattttagtgacttttttcatatcatatgtcctcctttgtgtgatatggtaattatttgttataattagaatatcataatgataatacctattcaacaacaaaaacaacacttttgttaatgatgacccttctgcttatctcatatgtttaatcttgctttgtatgcaatctctttaccatttgaagaatccggccgaatagaaacattcgagcaatatgatggcaaaaagaattcttgtatacatttcgtttgccttgaactcatagtccggatgtttctttttatatagaaaggatatggcacacagtatgaggaggacaataacagatgcaatgaataatatttttgtgaatgttatgatttgcaaatctgttaatatgaattccaatatgagtatgggagctacgatgtagtagagtattttgttgacgaggttcattgttttttcgttcattgtgctattccttcctgcttaaatttatgtgcaaactatatgtaatctgatatattacctacaaaaagccctctatcgcaaatgagaattattcacgacagagggattctttaaaccttatttacaatacgaattaatactgataaataacatcgctctttactttacattttaaattaggaacaatcttgatataataaatctgcctcgtcttgattgccttccctttaaatttggatattttcacattcttacccggctttgccgtcttaactttcttataacccttacttctatctttggatatatatacggtaaaattctttataccctttgcattctttgctttcggcattactactgtgtagtttttcttaccagtgcggtaattatatttatacttaagttttatattcgtcaatgtagtaaatgctcttgcttttgaaagctttccataaattgtcgttccattcactgataagtaagttctaaccttaacagtataagtctgattttttgctattttaaacctcacatatcgaatcactgttccataagatgcggaaagtgcattctgtgttgaaactttcttacctttataattatataagataacctgtactcctgtaacatccgatggaacggctacctgataagtaatctctttgtttgatttataatatggtgcaaagttctgatttgtgacatctgtcatcatcgtcgtagcttccatttctctgtccattactggcaccgctgctttctctgccgcattaaccggtgcctgaagtgcaaatgccatcactaatgccagagctaatgcaaatattcttgtaattttcttcatactgtatttcctccttttttctgtggtgtttggtttgtttccactttatttagcatagcataattatatcaaaactgcaatctatattcctgtcatttttatgcattttgttaattattttgttcttttttgaaacttttatcgtcattttgtcttttttaatatacggttattctgctgccagctcccggattgcttctatcgctgtcttgatttcttccatagtattaaagcttgagaagctgaaacgaaccactccctgttcagttgttctaagagtttcgtgcatgagcggggcacaatgtgccccggctcttgtggcaattccatagtcttcccaaagtatttcactaacttttccggcatcttcgttacgaatattcaaggctacaagcggtgctcttttttcctgatcaaagtttccataaacttttactccgtcaatacggcgtactccctcataaaacgtctttgttaaaagagcctctctggtatataacctttctaaaccttcctgctgtatgtactctaaacctgcctttaatcctgctattccatgtgcatttatcgttccagcttctaaaagttccggcatagaatgtggctgttctttatcaaaggaatggattccgcttcctcctgattttaagggacgaatagtcactccttttttaaggcacaggccgcccgttccctgcgggccaaataatcctttgtgtcccgtaaaacacagcgcatctatattcattgccttaatatcaattgggagaattcctgcggactgtgatgcatctacaataaaatgcagcccatgacgcttgcaggcctcgccaattcggtacagattcagcgccgttccagttacattagaagcatgtgtgcacacgatagcctctgtatctggccgaatcgcctcctcaaatgcctcacttgaaattgttccgtcttctccgactggaagaatagtgagcgctacaccttgctgttcttttaaatataagggacgtaacacagaattatgttccatcgccgttgtaatcacatgatcaccaggctgtaacatcccatcaattgccgtatttagtgcctctgtggcattcgacataaatgcaacctgttccggtccatctccgttaaaaaattcattaatcatctctctggtttcataagccattcgcatactatgtaaagcggcatcataggctcctcttccggcattaccaagattactgatagcttccgctactgcttttgctactgtttcgggcttctgtaatgttgttgctgcattatcaaaatatatcacttttgtccctcctgcatctggaaatctcattgtgaatcacatattttaccaccaatcatatagtggctttgtaattttcttctgtaaatgacttctgtaaataagtttctgtctgaatatattaccatattgcagctatttttctcaacatttattgtcactatatattttcttaatttttacatgaattttttctacagcatgtctagagcgtgtttgaaaaatgctttctgcaagatgtacatcacaatttgcgggagatttcgcctgaatgagggcggcgtagcgggctacggcaaccgaatgaaggcaaaatataccgtaaattggggtgtgcagattgctggaatgatttttcaaacacgctctaaagacaattgatactcaattcttaaataattcttaatcttgctcctaaagattttactttcgttttttattatgctatactcaatccacactattagaaaatattgtaaatacagcgtagatttattacacgacacttatatactaatgtactcttggaatctttttgttcttgattttgtgagaagattttttgtcagttatgcccaattttttgagacgtacacgatgcgtacgttgatgaaatctgggtgcggctggcggaaaatcagccacaaaagcaagtgcaagaaagactccgaaagtacatactacattcaaggaggttttccatgttttcaaagaatacatctacaacatataagtatttctttatgtttgtttttttcagtttatttttatggcagtcatttactataaagccagaggcgagcgagattatcacggatccgctaatttccatgacagtaggggatacaaagaatctctatttttttcacggtgattctgcttctgcctactttagctctaaccctaatattgcatctgtaactacaggtggtgttttgaatgcaaatgatgttggaagtgccgaaattatttatagcgtacatggagtatttcatcaaagaaagatcaatgttgccgatattgaaaatccatcttttagcactactcagagagagaacctcattttgccagacaatgctctgacaacaacggatcctgtcctttttatgcaaaaaaaggattcttacaccattcaattctcttcttcgagccaggcacttgccacccgttataaaggacttcttatctggaaaagtgataagccaaatatcgtccgtgtagattctaatggaaaagtcaccgcattgaagaaaggttccgcaaccattacctgcacactgggcaatgtatcctgtcacacctatgttaatgtaattactgacagctatacggggaaagcaaccgatttttccatgttaaccgcaactggaaatcagcgcacttaccggcttttcaaacaaaatgcacacaactatcctcgctacgattcttatcttgcatggcatggatgtgctacctgctcacttgctacggttcttggagcctataacgataattactccggcattttgccaagttctgttattgatggtgtagagaaacaatttacttcgaacaaagactggacaagggagcatgtaaaccgctctctccgcggacagatgcccctctctctgtacggaatttcttctatactgaagtcttccggtgttgataataattatgtaagaacctataccgactctgaggctaagcacgatattatctctcatttaaaaacagggaattctattatttttgaagtacgtcagaaaaacagccgcactggtaaaagaacaaagcgttggacaaactcctaccatactatggtgttactcggtgtactgacaaacggcaaggtgcttttatgcgattctgttgaccgctcctggtataacggtggacagcgtttaaaaattgttgatctatctgatattatggagtatatgttcccttgtacttctttttcagaaagtatgtattataacggagcaagctccgacggcggttacatcaaaatatacgaaattagttaattcgttccttgactttttggaaaatagtttataaaatatttttatggagcgccgcatttttcggcattttcaacaatttatgggaggatgtctcatttcatctatagttttattaatatggaaatgtatagaatctcatagcaattttttaataaaaggagaagaagtattatggcagcaaaaattttaatgactggcagtattatgatggatctgattttacagatgcctcgtatcccacatccaagtgaaagtcttcttggaactagctattctaacgctgggggcggtaagggaagtaactccgcagtagcagcctgcaaggctggcggagaagtttctgtttgtggtacactcggtaaagattccaacggtgaagcacttcttggcatgcttactgacataggaattgatgtatccaatcttacattaaaagaaggcgccaacaccggaatggcagttatcatgcttgaagaagacggaatgaaccgtcttgctatttatacaggagctaacaacgacacaactccagaagctgttgatgctgcctttgaaggaaaagaatatgatgcattaatgatgcagctggaaattcctttagaaacaaacgtacatgcatttgaacttgctcatgaaagaggaatgatcacttgtcttgatgcaggtccggcacaggattatccattagaaagattcaagggcctcactatcctctctcctaacgagacagaaacagaagctcttgttggaattcttcctaaagatgatgagacatgtatcgcagcaagtaaaatcttaaaagaacgcagcgattgcaaatacgttgtattaaagatgggagacaaaggctctttcatctatggtgatgacatctgccagatggttcctacatttaaagtagaagctgttgacccaactgctgctggcgactgctttacaggtgttttagtaaaacagtacgctgaaacaaaggatatcgttgcttccgcaagatatgcaagtgccgctgctgctatttctgtacagcatttaggcgcacagccatctctgccgacaaaagaggcaattgatgagtttattgctgctcgttcatagtttaaacagacgctctcaaagagagaagagaaaggataccctatatttgtgacctcagagcaaggtttggatgcgagcacataagcgagcattcaaaccgagtcacaaatatagggtatcctttctcttctagagcgtgtttgaaaaatgctctagagcgtctgtcacttaatcaattaaatagtagcgcaaatctcttgtatttttgcgaaaaaaatgttaacataacctgattatacttttagaaaggaagagcttttccatgagaaatgatgaaaaaatagatatcaatctcgccacagaagatacctcagagaatttatccgaagaagaactggctcagcaaaattatgagacggcactccgatatattaatattgccgaacatatgaataagtttgaagaccaggataaatattatcatcgtgcgattcagtatttaaaaaaggcaaaaccttataaaaaggttcaaccgctcctcagggaacttcgaaataaaaagttcggcactcgtgccgcaggtaagattgaattatataaagaagcctgccatattcgtgataacgcaaagacacctagcgattattattctgcacaaactatcttttcccgtatttatcattacgaagaaaagcatcctcttattgaaaagtggactgatccagaggtttacgctgaagcgatcaaatgctctgattcaaaagaacagatggaactttgtgctaaactcgctgatgaaaaagctgcccagttaaaacgtcatagttttttcgtaagctgtgcatttattgcctgccttttagcagccttattttttacaaggactgtttctttcaagcagtgtcttgccagcataaactccagttcaggtaactatgaaaaagcatggcaaaattaccaaaatatttataatagaactaacagcaaagatgcgtttaaaaaatatatcgaataccgttataaatctgctgaaaaagctttgaaagccggagatgaagatacagcttaccgcaattacaaggcaattgcaaaagaagattataaagacagtcaagctaaatttgtaactcttgagaaagaacatatcaaaaataccgcaataggcaaaaaagtttcttttgcgtacatggactggcgtgttcttgataagcaggacggcaaagttctcttattaaaagataattccttaggatctactccatttgatgagaccgggaaaaatgttacttgggaatcttcctccgttcgtaaatggttaaacagtggcttcctcaatgacaacttttttaaggcagaacagaatgctattttagacactactgtaaaaaatacagcaaatcctgtttataatacaccagccggaaaagacactactgataaactctttttattaagctgcgatgaagttgcacagtataaaaagggaattcataaaacaaagtcctgttggtggctccgtaccccaggtgctgctgcaaattctatgagttttgtatacaaagacaaaaccgttatggagtacggctatgaagtaaccaatacaaagattactgtaaaacctgcaatatgggtaactgtagaataaattctgggttgcgtagcaaaagacgcttccaaagagagccgataccaatatcttttaattgatttgtgaggggtaaataaacagttgctatagatattctttatcggattgccctaattaacagcaaaaagaagaggggattataaacttgaattttgtgacttagtgcaacggaacaaaatcaagcttataatcccctcttctttttgctgttaattagggcaatccgattacaggcttcagtagcggtgtcggccttgcctgcggcaactcattcttctagagtgtgtttgaaaaatgaatgctctagaacaatccagttatctttccattatcatctacatcaattccaaatgcagccggtttctttggtaatcctggcattgtcatgactgctccggtaaggattactacaaatcctgctccagcatttacaaatgcatcacggacatggatatcaaatccctctggacgtcctaactttgtctgatcatcagagagggaatactgtgtttttgccatacatactggcagagcaccaaatcctaaatctgtgagttttgcaagcattttctctgcggctggttcatatgttacaccatctgctccgtagatttcttttgcgattgtctctactttttcttttaaagataaattgtctggataaagtactttaaagttgctttctttttcttctaatgttttcagtactttctttgcaaggtcaattccgccttctccacctttagcccatacttcagaaagagcaaattcacatcctctttcttcacagaactgacggatgaattcgtgttctttttctgtgtctgtctcaaatgcatttaaagttacaacaataggcacaccgaatttctgaagattttcgatatgtttttcaaggttgcagataccttttttcagtgcgtccaggttctctgctacaagttctgtttttggaacaccaccgttatattttaaagcacggactgttgctactaaaacaactgcatctggctttaatccagccatacgacacttgatatccataaacttctctgcaccgagatctgcaccgaaacctgcttctgtgattgcaatgtcagaaagctttaatgccatctttgtcgcacgcacactgttacatccgtgagcgatattagcaaatggcccaccatgaacaattgcacctgtatgctctaatgtctgtaccatgtttggtttgattgcatcttttaataatgcagccatagaacctactgcattaagctgacctgctgtcacaggattaccatctacatcataggctacaataattttagcaagacgagcttttaaatccttgatatcttctgccaggcagagaatagccataatctcagttgctactgtaattacgaaatgatcttctcttacatatccatctacttttcttccaagaccgattacaatgttacgaagcgcgcggtcgttcatatccatacatcttttccagattacctgtcttgtatcaatacgaagttcatttccctgctgaatatgattatccagaagtgcagctaataagttattggcagatgtgattgcgtggaaatcacctgtaaaatgaaggttcaaatcttccataggaacaacctgagaatatccaccaccagcagctccacctttaattccaaaacaaggtccaagagaaggctcacgaagtgcaagaacagacttcttccctaacttttcaaatgcctgtgcaagaccgatacttgttgttgtctttccttctccggcaggagtcgggttaatcgctgtcattaaaacaagtttgccatctggcttctcatctaagctattcatgaattcatcagaaaattttgctttatactttccgtataactctaaatcatcctctgtaatcccataattggcagctacatctttaattgggagcattgtcgattcctgtgcaatctgaatatctgttttcatattcctcttcctttcctttgcgtatatcaaagtttatacactttctcttctgcttctgtactcttagaatacaaaaacaaaaagggcaacttcaaaagaagctgcccagacggtcggctaaaataagatgtttccatccctccggctacattgtgtttcttcacatatccgtcagtaaccggaatttctgctttggcagatttatgtttatatatttacacacttacaagtaaaagtcaactttttaatttgaaaacctgaaaatgttctgtctttcatataatattctttaccaaagaagatatactttatctactttattatttttaacatggaatttatctaatgtatagtaacaggccccatttatattttttaaaattcttttggcctttttcttgcttattctcttataaacataggtgcactcatctatgctataaaacttacatttagaactaagttttaactttagaggatctgatgtgtatacccggccgctaccctttttctgtacacttgagcttaaaacaaagtatttgcccagttttaattttacagaatctttctgccatgacttatattcataataatcagtctcaatcgtatatgttccattcggaagctttgtatactttctccatattctatgtgcctgtacctgtgtagctgaaaatacgctcaatcctacaatcaggcagcaaaataatgccagtctggttaaaacttttttcttcatttaaacttccccctttgtcttacatctccaaattaaacattctattccgagactttacttgtgctttcattctaccgcttccactaactttctgcaagttctttctacaatgaatttttccttaaacattttatattcacccctcactttatgcttaaagaagacgtcagttcttaattacatttcttataatacaccaatacatcctattattttttatctatcacagcacattttttacaaatttatccacaaatctgttaaacttctcctgttcttttctatcctcataaggtatactaagaacaaataatgtatctatataaactgactttctcacgcataaaaagtcacagcaaagaaaggaattacactatggaaaaaatcaaaatatccaaacaacgcattcttgttgccacattaactctctgtatgctctttacattattcgcacctgcagctaatgtaaacgcagcttctaaacgtacaaaagcactgactgcttaccagaaaaagcttaaaaaacttgattcaaaaatatataaatttgccttagtttatttagacaaagattctattccagagcttgttattacatcaaaagaatctatacatgctgtctacggagaaatttatacttataacaatggaaaacttaaaaacttaaaatatgctggtagtgattttggtcaattcatttattctccaaaaaaatctgtagcatgtaattcttcatggattaatggatatggtgctgtttctacattttaccgtcttagtaaaactggaaaatcaacaaaactcaaacgttttgatgccatcgtaaatccaaaaacttcttataagattaataataaaaaagtatcaaagaaaaaatattatgcagaatacaaaaaaatggagaaaaaatatcctttaaaacagatttctctaaaaaacgcttttaatcttactacgaagaatattaaaaatattaccaaaaattacaaatcctttgttgtaacaggggcgaaatattaattaaagttctgataaattcacaaatcattccaaagataaataggaattcatctaaagcgtgtttgcagatttcgtatagacgaaaaaagcagtgaaagtaaacgtcttctgagcaatccccttattcctatctgagatttaaatactactttgctatcaaaaacaaacagccgctgaaataaactttcctgctaaattgtaagaaaactatgataaagaaaaaagaattgttataatggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagagcaatcatgactaaaggaagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattgaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacatagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggtataaaaatgttgcccgatatccaaccgggcaacacaaaaattttatatttttttaattgtctacttgacgggatgcacaccataagtattgcattttgtgactttgcactatggaattctgaccataggaacttgggactcgtttttcccaagttcctgtttttctgggcagaatggaatgtttagtgcaacggaacaaaatctaacttataacaattcttttttctttagaatactccatacaatccagctctgtatcttctactaaagcggcgtctgtatccccgcaaattattatttagataacttctcaattgcagccttaattctgcttactgtctcatccttaccgataatttccataatctctgttgctccgcccggagtcatgcgctttccggaaacagcggtacgaactggccacataacaaatcctggtttataacctttttcatctgcaaatccacgaagcatctgatataatgcatcgtttgtgaaatcttcctgtgcttcgattactggaagtaattcctgtaatactggtaaagacttctctgcatttgtcttatttttcttgttagtatacatatctacatcgtattctggaactgcttcaaagaaatcaatcatttcaccaatttcagggaatacttcgattcttgttttaacaagtgctgcaatcttctttaagtccatatccttcttgatgacttccttgatataaggctctgccatgttgtagaaagtatcagagtccattgcctttaaatattctccgttcatccattttaacttaaccatatcaaatacggctggagatttgctgatatgcttgtaatcaaatgcttctactaattcttctaaagagaaaatctctctgttatctggagaactccatccaagaagtgctacgaagtttacaacagcttctggaacaaatccctgctcgattaaatcttcgtaagaagaatgtccagaacgctttgaaagcttctgatgctcttcattcgtaattaatggacagtgaatatattttggttcttcccatccaaatgccttgtaaagacgagtatattttggtgcagaagaaagatactcattacctcttacaacgtgtgtaatctgcatcagatggtcatctactacgtttgcaaaattgtaagtaggatatccgtctgacttgataagaatcatatcgtcaagctcttcatttggctgcgtgatgtctccataaatctcatcatggaaagttgtctctccctcattaggcatatttgcacgaataacaaatggcttacctgctgcaaggttcgcttctacttcttctttggaaaggtgcagacagtgcttgtcatatacactgatttctttaccacctacattctgttttaaggaatctaatctttcctgatcacagaaacaatagtaagcctcacctttttcaataagctgctttgcatagtccatgtaaagtccggacgctacacgctcactctgaacataagggccaaatccgccgtctttatccggaccttcatcatgctttaagccagtcttctctaaagtacggtaaataattcccagtgcttcttcacagtaacgtccctgatctgtatcttctattcttaaaacgaaatctccaccttcatgctttgcaatcaagtaagtatataaagcagtacgaagatttccaacatgcattcttcctgtagggcttggtgcaaatcttgttctaatctttgccatctctaattcctctctttctgaatctataaaatataatctaactatttaaaacccaccttatccaaaatgtatctggaaaatgtattagcaataactatatataccatcactctgcacatcttctatgagactattgtatagctgacaataaactctgtatcccttatacacccggaaatatacagctttaaatagtttccaatcgactcgtattatcataccatcttttcgcgtaaaaatctataaaatcctctatatgaaataatttgcggaatattctttattatgctactcttattttaatccattgtcagtaatttacggattctgaacagatagctgctgctaataatcattccttttttgttagaagtggataccggttcatctgacactacttatatataacttatataactcactgtctctttgtacagcaccgagatatacatatttctgtacacaactgcaaaaaatttataaaaatatattacgaaagaaggttctcttatgctatcactactaaatattgattacagctccatgataagcacacttccactagactccggaagcagcgacagtctgagtaattttataaacaacggacttgtcggtctcgtcaccgaagccaatacaacttacaaaatagctggctctgtaattgctctcattttagctctcatcggatgctttttcggctataaactgtcccggctctttatgggcattaccggatttattgctggcgctataatcggacagatagttgcttcccagattctgcatgtagaaggatttgcctccgtcctttgtatcatactttgcggagcattcattgcctctctcgccttttggatttatcgtattggaatttttattctctgctttgcattagcctttagtgccgcaggaacattatttccatttgaaggtgatgtacagttctttgcgaatgtaataactggtcttatcgttggagttctcgctgtcaaatatatgcgtccagtcattatacttacttccgcaatcgtatgtggaacttccgctgccgggctacttccgggagttacggaatatatgggaattacgacactttcttcactgaactccagtgcagcgctgacactggcattgtgtgtgctcgggattgccgtacagtttcttactacgaaagaaccggtgaagaaaactgttcccagacataaacatgggtaggtgatttgccacaggcaaaagagacgccctctgagaatgaaagaatccttatttgtgactttagtcgcggcgtgttgaatactcgttctactcgctcgtatccaacacttgctccgaggtcacaaataaggattctttcattctcagagggctgtctttggctattgaagcaaactcagaatttgtttttgagaaatctgaggaagttttcaaaagattatgacttttcggaacagccaatgcacaaaactctactgttcttcccaaagaacaacttctcctgtttccagcgtcttcttcacatcaataattctctgattagaagaaccgcggaatttaagactaatattctttttttccataacaaacggaccatctacaagataatcgatctgttctaacatcttctttgtatacttccactttggaatcattctgtgtaaaatgtccttttcataaacataaccagtaaagcaccagatactcttctctgggaagcgttcttttaccttttttaaaaatggaaagaggacttcctgattcatatattccataggttctccgcccaatactgtaagtccagatatataagatggttccaataatttcaaaatctgttcttctgtttcttctgtaaaaggctttccatactcaaaactccatgtttcctcattaaaacagcccttacaatgatgggtgcatccacttacaaaaagggatactctgacacctggtccgtttgcaatatcacatttcttaatttcaccgtaatacataacctattcacctctttcaaaaatcaaatagagtgcccattatatttagcaactacccaaaccaatctttcgtattatatatacaatacttcttctatattttacatggttcttactaattacattttataatattggcactctatttacaatcaataatctactattttatatattttgagacaattttattttttagtaacacataatttggcagtatattcattatctcagcttatattttgttggtattttaaaattattcaaatttccccatacaaacattaccacaaaatagtaacttcaactccagcaaaaaacagcgcccaaagggagaagataccttctccttttgggcgcgtctccctgcctgctttctacaaatgcattacacgttccttaatctcctgggttcttccctgattccagaactgtgttccaatataaccgcaagttcttcttgctacgttcatctttgcctgatcctgattaccgcagttcgggcattcccagatgagcttaccgtgttcgtctgttataatctggatttctccttcataaccacagcactggcagtaatcgctctttgtgttaagttctgcatacatgatgttctcgtaaatatgcttcataacagctaatacagcctcgatattattctgcatatttggtacttctacatagctgatagctcctcctggagagagttcctggaactgtgcttcaaagcttaatttatcaaatgcatcaatttcctctgttacatggatatgatagctgtttgtgatatagtttttatctgttactcctggaatcataccaaaacgctcctgaaggcatcttgcaaacttataagttgtagattccagtggtgtaccataaagactgaagtcaatattactttctgctctccacttattacatgcatcattcatatgctgcataactttgagtgcaaatggttttgcttctgggtctgtatggctcttgcctgtcatatatcttgtacactcacaaagtcctgcgtagccaagagagattgttgaataaccattatataaaagttcatcaatggtctctccctttttaagacgtgctaatgcaccgttctgccagagaataggtgctacgtcagatggtgtaccttttaaacggttgtggcggtacataagtgcctcgtggcaaagttcaagacgctcatcaaagatttcccagaacttatccatatctccacctgaagaacaagctaaatctactaagttcagtgttacaacaccctgattaaatcttccgtagaactttggattatcgttctcatcatgatataccgttaagaaagaacggcatcccatacatgggtagcagtttccgtcttttaacttcttcatgattttctcggaaatgtaatctggaaccatacgtttcgctgtgcattgtgcagctaactttgtaagataccagtatttgctgttctcatgaatattgtcttcctcaagaacgtaaataagcttagggaaagcgggtgtgatatatacacctttttcatttttaacaccgagaatacgctgattaagcatttcctcgataatcattgcaaggtcatctcttgcaggaccttcttctacctcatcaagatacatgaatacggtaacaaaaggagcctgtccatttgtagtcatcagtgtgataacctgatactgaataacctgaactccctgcttaacctcttttcttacacgcatttctgcgatttcatttatcttctgctcatcaagttccattccttctacttcgaactccgcccgaacgtcacgacgatacttctgacggctgatttcgacaaatggaaccagatgggaaagtgtaatactctgtccaccgtactgggaacttgcgatctgggctactgcctgtgttgcgatgttacatgctgtagaaaagctctttggcttctcaatcataacgtcgctgattactgttccgttctggagcatatcttctaagtttaccagacagcagttatgcatatgctgtgcaaagtaatcagaatcatggaaatgaatgattcctgcttcatgtgcatccacaatcttctgtggaaggaggaaacgtcttgtaatatccttacttacctctcctgccatataatccctctgtacactattgaccgttgggttcttgttagaattctcctggataacttcctcgttattacactctaacagactcagaatctgcttatctgtagaattggactttctaaccaacgctctcttataacggtaagtaatataattacttgccagacggaatgccttctggttcatgatctgattctctactaaatcctgaatctcctctacattgagcgcacgattcattccctcacagatagtctcaacattctctgcaattttctctacctgttcgtcgcttactttttcaccttctacgacactgttgtttgccctcttaaccgctgcgataatcttgctgcggtcaaattcaacttccattccacttcttttaatgatcttcataccaacactccaattataaatttttaaaaatcatgcattgccattgtaacacataattttgtatgatgcaatgatactttatacaagatattgtgttttagtcgcataaaaatctcacagcaacacaaaatattatcttgctgtgagatttgccaatacccattatatgatgttttcccgtaaatatcaatatgctctatgaataatcttgtactaatattttccctgttttttcatcagattgacaaccgctttatagagtgcttttccataagcgcttgtatttgccttcattcgggcagactcttttttattactgataaatccgtattcaataagacatgctggcatatttgtgtgttttaaaacatacagatttggtctgtcgacaagtcccctgtttgtaaatcctgtagctgcaaccgctgcactctgcattgctttagcaagagtcttggaagttaagccttttttctgtgttgcagagtttctgctcttactccataaagtctctgttccatgtgcagaagcacttgctgaattgatatgtacacataaaaacatatctgcattcttattattcgccagcttagctctctgagacaaacttggatacgtatcggatgttcttgtataggatacctgaaatctgctgtccttatcaaaagaacgctttgcagcgagtacaatagctaatgtcaggttcttctctgccattccattccctgtcgcaccagaatctgatccaccgtgtcctgcatcaatgacaatcttaatcttatctttgctgcttgtcgtactcggtttcgttgtggttgtcgttgtgctgcctgtcgtattatttgaactactctgtgtcgttcctgaaatataaatccttccctttgacagcttgtagttaataccaagtcttgtacacacactattaagcggaacaatccatcttctcttacctgtagctgtgtatgttccatgaactactggtgcccccattgtacttttctgtccattcgttactgctattctgctgtctgcccgtacaataactgtgtttggaccataagttaaagttaatttatcacccttagctgttgccttcacctttaacttactgttctttaaaatcgctcctaccggtcccatatatgctccggacttcttaaaaatcggatactttgttaatttcctcttctgtccattcacataacaataactctttcgtccggtataagaactggtaaccccttttactgttctcacgcgaacctgtgctgccgcatctgtattaaccggcataatcatacagatacataataacaatgctgccagcacaccgactactcgctttgctttcatcaaactctcctttctcatctctctgaacttcacatcctcttgtcttaatccattctataacaatttcataaaacaatgcaatagagccttataacattttataaaacctctacaaatatcttatacatcaaaacagtatccaactccataaaccgtcttaatatacggatattctttggttaacttagctctcagcttcttcactaaagtatctacactgcggtagccgcctatatagtcaaacccccatacagaatcaagtatcttatctctggagagaatcatccctttatgctttacaaaatattctagtaaatcaaattccttcgcagttaccttgagaaccttgtctgcaagataaatctttcttccttcataatcaatggataaggctccaaccgattctactggattcctcttttccgccgtcctgcgtattactgcctctacatgggcctctaataatggtaacggcgctggcttcaccatatagtcatctatcttttttgaataagcgtataactggctgtccaatttatcatcctgtgagagcatcagcactgccatatcagataaactccttatcttttcaagtgcctcatattctcgtctcttcggtagatctacatcaaaaatcagtaaatctggtttgttctttcccctggaaagaatttctgtcgcctcatcatattcggtgcaccagattacgctgtaaccactgtcctggaaataagctgccatctctttgcactccgcttctttctgatttagaatcagcaatctgcttgtgagcattcgacatcttcctttcatcattatttgttaaaattatattacaacatcatgacccaaaaatgacttatttaaaattattgtaacatagacagtaattatgaacaacccttgttaccatcttacagggtatggaagtaaaattcaagtggtttttttacagacgaaaatccgaaccttagaacgtgtaataaatacttcgtttcactgcgttccaaatgctcgtccgcatttggaacttgctctaaggcgtatttattacacgctctaaggttcggattttctgtccttagtaaaaattttgttcaaattgttactttccatttggaggggaggtggagaagaaattcaaaatgatattataaaatataaattataaaggaatatagtagagatataagaaaaatcaatatcattagttctcaagaaaggaactggataaagttggtacgagattatttgaatcaaaaaaacagaggaaataaaaaagaattataaaagattaaaatttctttttcgtttcctctgtttttgattataagaacatatttattttgatctataattagaaattataggaatcgccgggattataataaatcagcgatttcgtaaattaagcgttcggatttctcccagccgaggcaagggtcggtaatggatttaccatagcagccgccgcctactggctgattgccgtcttcgatgtaactctcaatcatgagaccttttacaagtcctctgatatctttggaaagatggcagctatgcattacttcttttgcaatacgaatctgctcaaggtaatgtttaccggagtttgcatggtttgtgtcaataattacacctggattctttaagctactctcctgatataactcaaacaattcatttaaatcttcgtaatgatagttagaatatgtcttaccatgtttgtcaacatatcctcttaataatgcatgtgcatatggattacctaatgactgtacttcccatccacgatacaggaatacatgctgtccctgtgcggctgtaatagagttcatcataacggataaatctccacctgttggattcttcattcctactgggattccaacaccacttgcagtcagacgatgctgctgatcttctacagaacgtgctccgattgcgacataagataataaatcagaaacataacgatgattctctggatataacatctcatctgcacaagtaagtccactctcaagaatcgctctctgatgaagttcacgaaccgcaataataccctgaagcatatctggcttcttttccgggtctggctgatgtacaagacctttgtatccgccgcctgttgtacgaggcttattcgtgtatactctagggataatcataatcttatccttaactttctcctgcacttttgataatcttgtcagataatcaaggacagcatcctctctgtctgcagaacaaggtccgataattaataataacttgtcagactttccctcaaaaattcttcggatttcaggatctctttcctgtttaatctttacgattctctcatctgccggaaactgctcttttaattcctttggtactggcagtttcctgaaaaatttcatatccatatccataatcgtctgttctcctttatattactttcttctttgtaaaaatgattgcgtatttataaatcttccttatcttaacataaaagatgtattcacacaacactttttagctttaaagtgtggaaaaatatttttcaactattttagaacgtgttgcaaaaatgatttttcaaacacgctctatatattttgcgagagatttcaatattttttttacttttaccttctgatgctttataataatatcatataataacgccaaagcacgtttgaaaaatattctaaaaattttcaggaggaatttattgtggattctacaaccagcacaatcacagaagcttactctatggattctgcagctaacacaagcatagagtcttatactatggattctgcggccagcacaatcacagaaacttactctatagattctatagccgacacccttgcaaaggcttattctattatagaagaaggaggacagcctttagcttcggaaactacttgtatacaatacatatttttatctccttctcacattgaagctttccacaataatgaactgtatttagaatatatccagaatctcgtaaaagaaaggttcaatgtttcctttcctgaagaaaagtctacatttgaccaatatttttcagattgcattcagctaaaagaacagttagagtcccacggaaattttgataagactgtatggctttcttatacaacaagccttcttgagtctttaaaaacaccgtactattccgtgtattcttttactttactgacgttagagtcctgttttacagacccacagctttttgataaggttcagaagtctttttactctgtactaatcaaatcttccgaaaaaaaacagtctattataagaaaaattattgagcacgcaccagtttataaaaaatattcttatatcaaagaaaatcttctttctgatattttgataaataccctggctctttttggtgatgaaaaagaatactggctggcatcttttattaatctttttgaaaataacaatgccgtacattctttacctaaaaatacaagtaacaaggaatggaatactccctctcttttaatgacattttttgaatgggaggaactcttcttaaaaaacagagcatcaaaagatttttcttctttttctgagtatctttccagcaggactttatatttttataaacacgccggaactacttctgataatttactgaaaaatgcaacaagcaacgcatctgtcacatctgcaggaacctctgcctccatagattctgcaattctgtcaaatatagaaaatgcttatgtggacagcgagtttttaaatacttttgcctacaacatgaccacacgcctttatcatgctaatccggcaattggtcgcgatcaggagatttcagatttagaattaattttgatttctcctaaaaaatctcctttattaattggagaagctggtgtcggaaaaacgtccgtcgtagaagggctggcctatcgtcttcagcgcggcactgtccctgatttgttaaaaaataaaaaaatatttaaattgactacgacttctcttttgagtggcacaaaatatgttggcgaaatggaagaccgtatcaaaaagcttgctggcgaattagaggcacaccctgatgtcattttatttatcgatgaaattcatacaattgttggagcgggctccacagaaagctctaataatgacatttcaaatatgctgaaaccctatattgacagaggagatattaaaattattggcgcaacgacacgagaagaatacactcgttttcttcttcctgacaaagcacttacccgccgtttttatccaatttctattgaagaacctgatgaagaattaactttatctatccttagtggaagtattccttctatagaatatgaaacaaaggtaaaaaatactttctctgctaatacaacggaacgaattctgcgcactttaatctctatatccatgcctgaaaatcagccagatgaccagcctgcaaagcgtcccgaacttcctctcacacttttagagatggccttttcctatgctgcgctctctggaaaaactgctttgtcttgtgaatatatcgaacaggctgtacaccatagtaatcgcttaagaaaagaaatccgaacaaactttacctgtgcattgtaagatttttatggtatttctgaaaaacttcatatagaatagaaactatagcaacttcataaactacgtctgcatacctgtaataaaaaactgccaaataggcagactaacagaaaataataaataaattgggactgtgtaattaagattaaatattatgttcaaaaataaaaataataattatgaatcagaactgccttcagtcaattctctttcataaaaaaaccacggactcacccctagtgtactgcagattgttaaataatcatccgcggagagtgagcccttagcctttattaaagaggacttagaaagtccagtagagatcataaatgtttcttcggatatattatgctgctctaaataatctattatcttttgtaaatttatcataaagcaaccatccttaataagagccttttactcttagaaactaaacacattatagcatagcaattctatttaaacaagaaatttttaatattttttctagtttaaatagaatttccacaacaagcggaggccgcaatgagaaatgacaatattgcacgatcattaagatactatagaaatgtcaatcacaaaagcattgacgatatcatagcttttttaagagaacatgattatgatgtctctgaaaaaactatttacgcatgggaaaatggttctaaccagcctcgcgcagatatcctcatgctcttatgcgaatattaccagatagatgatgtccttaccgcctttggatacagagatgctgagacctctttccttcaagacccactgtctgtctcggaaatctctctcataaaatcatatcgtgaacacaaagaaatgcagccagcagtacacaaattactcgacctgccagcaccagtaacaaggacgcgcagaaaaagaaaacctaagaaatccaatccagaagtctgattcacagaaaaaagttcttgcattcatattctatttatggtaaaattaatattcgtaagcggatatggcggaattggcagacgcgctagattcaggttctagtgagcattacgctcatgcaagttcaagtcttgttatccgcattacaaaaatagtaaagggtttggaacatctccaaaccctttattttttatctggagcgtgtctgaaaaatgctctaattcttatttttcaaacttcttattccataattccactgtactagtcatcgccccactaaaaccggcctctttacatttctttaatttttcttctgtattaacaaacccagctacataatattctccgtcccatacttttttaaatgtaggaagaaattctatagcatgataatacggacgtaactcaatagcatcgaatttcacctcattgatcgtcttcagggcattatctacagaaatggaatccatcagcgtaattcgataaatcaccttgacatttaatcccttcatcatatgtaatttcgtaatactcgatccaataattccatccacatgataaagctttttgagcatttgaaaagcaatcctgtcttttcccagtccatctaccaattcatgatttacaataaccgtctttccagcctgatgacatatgtgactaagctgctgcaaatttccaatatgaacacctgtaagctgtatacagagattatcggattgtatcgctttttttaagtattttacctcttttacagatggaataattttaaaattacttgtatttttctcattctccataataattacattttcctttgcaaattactgttttcattataatatattccccagataaattaaatagtaatttgccggggtgaatagacagacgaagtctgagaatcaaatcactccaacaataaatagcaattccctcccagccaaagcacagcccccgaagagagtctaacccctatatttgtagcctcggagcaaggtttggatgcgagcgtttaaagcgagcattcaaaccgccgcgactaaagtcacaaatataggggttagactctcttcgggggcgtctcttttgcctgcggcaaattcctatttcaccgtcttacaggcgactaattctactccgcttcctgcgaggttttccttaatgacatcccccatcttcactggagcattcacttcaatttcctgaatctctttcatagcctctgtcataatctttcgtggaatcggttctttggattttacagggatgagcagttctttgccgttaattactgcatatacagtacttgtcagcatacgttctggatttatccattccttgtgggcaaatttttctcctcgtgggcagttatttccttctacgcttactacttcgttgttgtcaatcattacttttaatgcacagccggaaggacaggttgtgcagcacattgttacttctttcattacagtagcctccttctgtaattatgtatactcagaatctttctatgcttaattttgtaagaagatttttatcagttgctgttcaattttcagttatacattgacaaaactcaagtacaactgataaaaaatcaatgctaaagaaagatatcaatcatacatattaattaaactaatgttaccttaatctcgtcctgaacgtctgcaagctgtgcggctgtcaggtttacattttccattatactcggtacaaatttctttgcttttttgctttcaaagattactttatcgccgcttgtaatgcggatttttgcagtttccactggtctgccgacacggaacttaatttttgtaactggggttctgtttgcacagattcttgttggaaccgtgtagcggaccatgccttctgggataactgcaatttctgtttctgcatttgaagttccacatgcttctgctgctgtctctacatctgtagatactgcggcatctgcctgctgtgcggctgcacattctgcagcatattcagccgcataagtaccggcatcttctgcttcttttgttacctgatctacaaggtcgtgtacatggagcacattaccacaggcaaagattccttttacggatgtttctaaagcgttgtctacttttggcccatttgtgactgggtttaattcgattcctgcttttttggagagttcattttctggaattaatccaatggataatagtacagtatcgcaagggatgatttcttcagttcccggaattggttttaagttttcatctacagcggaaacttctactgcctgtactcgcttggaacctacgatttttgttacggttgtacttaaatgcagtgggattccgaagtcatccagacagtttttgatgttacggtaaagtccatttgcatatggcatcagttcgtatacaccgacaaccttaatgccttcgagggttaatcttcttgccataataagaccgatatctccggaaccaaggatgacaactctgcttcccggtttgaagttttcaaggtttacataacgctgtgccagtcctgcggtaaatacacctgccggacgggttcctggaatacgaatctgtcctcttgttctctcacggcatcccatagcaaggacaacagaacttgcctcaaaaacaagcattccgtcttcactcatagcaacgacatgtttatcttctgtcacatcaagtaccattgtatttaagtaacaggaaatgtctgtttctgccaccatatctacataacgctgtgcgtattctggtccggttaattcttctttaaatacatggagtccaaatccactgtggatacactgatttaaaattccgccaagttcatcatttctttcaagaactgcaactttttctactttttctcttgcctttaatgctgctgcaagacctgccgggccgcctccgataactactacatcatattttaatgtcctcattttctctcacctcaccctttaatttttccgtataatacctgtgctccctgttcttcgaaaagtacctgttcttcagggattccaagttctctggaaagaatctgcattaccttgtactgacagaaaccactctggcaccgtcccattcctgcacgagttcttctcttgacaccttctacggttcttgcaccaagtgtggaatgaatcgctgcaatgatttcaccctctggaacagtctcacaccgacatacaattttaccccaggcagggtcttttttgatgagtgcatcctgttcttctaaggaaagatcgctgaaatccgggattggttcacggtatgggttgtagtctgatttatctttcagatctaatccggcatttgccagaaggtctcttacatactcagcaatcgcaggggaagaagcgattcccggggactggattccggcagcatggataaagccttttactatctcagattcacgaatgtagaaatcgtttccgttgtttaatacaactggtcgctgtcctgcaaaagtacgaataatacatcttgggtcaaagtctggaagaagcattttggctccttttattaattcatcaataccatgtgcatcgtttgttacgtcatatttatcttctcgcattgtggcagtcgaaccgataaggaagttaccagaaacagtaggaatcaatgcgatgccttttgtatccggtcccggacaagggaacataactgtatgaatcggaagcactttatccagtacgcaaaggtttccgtgacggccttccacctgatattcgtggatacctgccatcgctgcaacatcgtccgcatgcacaccggctgcattaacgataaaacgagtctcatactgtctgtcctgtgtgtatacaacaaagtcttcttctgcacgtttttcaattttacgcactttctggcaaagaccaagttctacaccgttctgcattgcattttccataaaagcaatggctacttcaaatgggtctaccattacggttgtatttgcaagtagcgcacctaacgccttatcactgatatgtggttctctgttatggagctgctcaaaatctaaacgttctactttttctacaccgttgattctggcattatccatcagttcgtctaccttttttaaatcctgatcggagtaggcaacgacaagtgttcctgtaggtaatattttaaagcctaattctttagaaagtcttggatacattcttgctcccggaggattcagttttgcttttaatgtgcccggatgcgggtcataacctggatggattactccaccattttgttttgttgcagaaaaagctacgtctgtaccgctctctaacaaaatcgtttttaactgatattttgccagttcatgagcaattcctgtaccggtgattccaccaccaataattactacatcatacttcatatgtctacccctttctagattaaaagattttataaccagtctttagatttctctactgccttgcaccactgtgcgtaaagattttctcttgtttcctcatccatctgtggttcaaatactctgtcggcttcccataattccttgatttcatcttcactcttgaaaataccacagccaagtcctgctaaataacatgcaccaagtgcggttgtctcaatgtcttttggacgtacaacgcggcaatttaaaatgtctgcctggaactgcattaagaagtcattcttagaagctccaccgtctactttcagctcttttaatttgattcctgaattgcgctccatctcttcaagaaggtctcttgtctggtatgccatggattctaatgctgctcttgtaatctgttcttttgatgtagcagcagtaataccaatgatcattcctctggcacctgtattccagtgtggtgcaccaagtccggtaaatgcaggtacgaagaaaatgcctccgttatccgggatactttctgccataacacttgtcttagcagcatggtcaactaagttaatcttatctcgtaaccactgaataacctgacctgcaattaaaatacttgcacccatagaatattttacttttccatctttaccccatgcaactgtgagaagtcctttctctgtttctggtgcaacatcacctgtatacatcagtggtactgcacttgttccatatgtattctttgctgcgccttcctcgaaacaagcctgtccaaataatgcggcactctggtcaccagcaatacctgtgattgggatttctgcaccaaaccattctggatctgtatatccaaagattcctaccgatggtttgatttccggaagcatacattttggaatattcagcatagaaagaagttcatcatcccattttaattcatgagcgttcataaccatagaacgagctgcgttagaataatctgttgcatgtactttaccttttgtaaggttataaagcagccagcagtcaattgttccgaataataattcacccttttctgctctttcctgtgcgccttctacttcatcaagaatccagcggatcttagaaccagaatacgttgggtcaattaccagacctgtctttttgtttacagtatcgttgtaaccctcctcaatcagtttcgcacagatatctgccgtacggcggcagccccagacaatcgtgttgtaaatcggttctcctgttgccttatcccagattgttgtggtctctctctggttggcaataccgattgccgcgatgtcttttcctgtaagacctgcttttttaattgcattccgggatgttcttaatgtaacttcccacacggtctttccactctgctcccaccagccggaattcgggaaaaactgctcatactcttcatagtcaatcgctactgttttacccttctcatcataaacaacacctcttgaccccgttgttccctgatccattactaaaatgtagtttgccatatacctgctcctccttttttaattgttcctgccagcttcaccctttaaaaccggtcaggatgttagataattaaaaaagtcctgcttaataagactgtcaaaacttcaacagcctcataagcaggactcataactctctcccgttaatacattattttgttgtatcgaaaataaatattataaactttaataagcctttgtacttcctctcatcaatatcactactgattattaatgaagcagtatcctacacatcgtgatgtactagtttggcatatccttgtagaatacttcaagaatctctgcggcagatgcagcacctgggtcaagatgaccgatagcacgttctccaagtctcatagcacggccttttgttgctacaatatttcttgtagactctaaacctgccttaccagcttcaacagctttctccatagcttctttggctggtgttccgccttcgtattctttgcggagtgtctcaactgctggaacaaatgtgtcaagcatagttttctctccagttgtggacttaccacgctttttgataatctcaacacctttttccatcatggcgataaattcttcaaaagttgctccctcatctgggccttttgtcttaattggaagtccaaacttcataaagaagcttccgtaaagtggtcctgaagaaccgcctaccttgtcaagaagtgctgtaccaactttgttataaaagtctcttacacttaatcccttccagtcttcaatatttttattaacttcacggaaaccgatagaaaggttgattccgtggtcaccatcaccgattgctgaatctaggtctgtgaaatactcttttctatcttcagctaaaacaattaaatctctgattacctgtacgaagtaatctttacttaacatgtattcactcattattaatcacctttattatttctgtgtaaagtatggagtgtcgcaaggtgcatccattaattcttttaattcgtcatccagtttcattaatgttacagacataccagccatatccatagaacaagcaaatggtcctactaatgctttgtaaactttgattcccttttcttcaagaatctgagctactcttctataacatacatgaagatcgataagtggtgtagcacctaagctgtttacaagaacgtaaacttcgtctccttcaacgtatggaagatctttaaggattggctccataatctcatcaattacattatctgctgtgtcgatcttacctcttctgataccaggttcgccgtggatacccataccgatttccatgtcaccatcttccatatcgaagatggttccgccctttgcaggaagagttgcagaagacattgcaacacccatagaacgagtattgtcattcgctttctgagctgctgctactacttcgtctaagtctgcaccagttgctgccttagcacctgctactttaaatacgaagaagtcaccagcgatacctcttctgtcaggaatattctcagaagaaacaacatcgtctgttacgagaactgtctctactctgatatcgtcttcctcatcagccttctcagctcccatatcgaagttcataacgtctccggcataattaccatataagtaaatacatccttttccgttatcacatgcttttgctgctgcgtagcatgggtctggagatggggatgtgttaatgttaccgattacaacagcatctgcgaaatcttctcccacataaccgatgaataatggctcatgtcctgaacctccaccgatgataacaccaactttgtcctttgttccagcgtcattcgctaaaacaacacgtccctgtgcctcatctaaatcacacatcttaacatattgtttatgtgcgcctacataaccttctaccatttcttctacgatatcatatgggtcgttaaaaagtcttttaatctttgccattgtaagtctacctcccaaaacttaattagtttttatgtacattgcgtgcatcttctgatgctttgataacatccgctacatcatcgctgatcgttccctgaacaacaccagctaaagcaccttcaacaatcggtgcgtctactaactgaaccttctcagctaaatcttcatcaattaaatcaatcgctgtctctgcgcttaaaatagaacttcctaaatcagcatagattaagatatgatcacaatcttctacagattcaatagctccctgaatcttgattgcacttgttccgattcttcctccgtctgcgccacctgcagcaactacctgcacggaaccatcgttcatctcatccacaagttcctttaagccctttgcgatgtattcgctatgtgatacgagtactactccaaactttgccatgtatttctcctcatctctggtcttctgttataatcagcctttataacaaaagtataattgcaacataaaaaagccatcatcatgttgcaatacctacaactattctagttcattatccattaaatttcaatatatttttaaaaaattcataatttatttaagaacatctctgataatcttgttaaaattatctgcctgccatgcagaacgtccgataaataagccatcaatgtgttccatcttactcagacctactgcattctccggatttacacttcctccatataaaaccggaatctcattccctgcctcttctccaaagagttcaactaatgtttcgcggatgacgatatggatctgctctgcatattccttcgttgcaggctttccgttcaccccaatcgcccataccggttcataagcaatccaaagcttttctgtctgtttctccgttacaccgtaaagccccttctttaactgaatacggataacctcctctgaaattccgtaatccttctgctctccggtttcacccacacataaaagcgttgtaaaattatgatttaaggcacataacacctttttattctcttcttcatcggtctctccaagaacatgacgtctctcagaatgtccaatcattacgatatccgttcctacttcctgaagcatcagtggagaaatctctcctgtgaactgtccctgttcctcccagcccatgttctgtgctccaaccatcaaaaggtcttcatcttttgcttcattcgcatctctcagcgttgtataagaagggataacaaagagctgcatgtcttctctgctgatatcctttgtcagctcctgcaactgagaaacaaattccacagtatctttgattgtcttatacattttggtatttgtaccaaagtaaatcttcttttttgccattatatcgacctttctagagcgtgtttgaaaaatacttactaaaaaatgtacatcacactttataaatgcttttcaaatacgctataatgcaaatattttcacttcaaacaacaacaccttgttattttagcatatattttcatttttacccaccgtaatttttggtaatgttgcgtatatttttttgttgttatggacagacgaaacccgaaagcgcagaatattccagatgtaatattctgcgctttcgggtttctgtttgttgctaaattcaaaaatactttgctatattggagggggatttgtggcttttctcttcgggattgtctgttaatctatgtctgttgatttacgtctgttagttattttatcgtagtttccttcattaatgcgtccatcaacttagtgtactgtaattcagaatgaatttcatcttcagaaatggcggaaaggacttcttttttgtctttatatccaagttcatcgatgtagtactggatttcttcatctacgtcggcatctgttatttcaatgctattctcttttaagagtaagtcctgcacacactgttttttgagattttctttggcgtagtcttcgagggacatttcgtagtactgttcaatgaaatcacttacgctcatgccaaagtatcctgccatctctttattctcaattttaatgtttgagacttcctttttgatatctgcttcagagaaatctttaagctgtgtagcattatccataatcttattccagagtgtctcctggtttgtctgctctgcctctgatttcttatcgcttacaaggctgtctcttacctgctttttatattcttttactgtcttacagtctgtattttccttgacaagagcatcattcacttctggtattacttccttttcaatcatgttaatagaaactgcaagttcacattttttacctgctatagaggaatcgtcataatcttctgggaaagtaaattctattgttactgtatcaccaacttttgctccaataagtttctcatcaacatcgacattctcatcaacatttaagttgccatctccaagatgcatatcgagattgctgtctgaataatcgctattctctttgccgttaattgttgttgtataatctacattaagataatcgtctttctgtacggtctttctatccttaatctcttcataggatgcattatcgtgggctagttcattcacctgatcttctacatcctgatcggttacttttgtggatgctcccttaattgtgagtcccttatactgtccaagcttcacatattctgatgcattaagcttcactggtgtagccttcgcctgctgcgcggcttctgtagttgcctctgctgccttcttactggactttgatgttgcacatccgcctaacatacagatggatgcaaatactgctgttgcgataaatatctttttctttatcataaaaatctcctctttattatttcattatgcgttttcgaattgccacacctattttattactgtaccattaatcatacaatcttaccattcttttcacaaaatctacatatatttcttttttctgtctattttatgactctgggcaaattatttttttgaaataccattttacagactatcaagttgttttttattctgaaaaactatttctacagactgccaagttattctataattttagaaaatcatttttgtgacatcatctcccaccttagagcgtgtctgaaaaacgctttctgcaagatgtacgtcgcaatttgtgggagattccgcctgaatgagggcggcgtagcgaactgaatgaaggataaatctaccgaacaattttggcacttctataacggctaagacacgcatataactcctgctttcttggtaaaacaggatgacctcctgagcaactggctggtataattgcttccattcctcgtttttctatgattgtatacattctttctattatatgctgaatatcttcttcagctttcacattatcaagaatccagctcatcatatgtgcaagtgctgttgtctgcccattttctgaaagctgctctaaatagcggacatctattgcctctctgtcaatcagaacggtatctgttcccattgattttattttccgtctgcccggctttaccggttttaatttgcgggaaaatgccgggactgtgatttcattttctgggtactgccctgcaattccacattcctcgcaaatagatttcgcttcttttgtaacgtcttttactttataatgatccatctgtaagacgaaatctgccacagataaataatctccagaacttcctactacaataacgaaagaaattcccagtgttctataaattcctcttatatgacgaagcaatgttgtaattggctctttttcgtcagatactaatcgtgccatcaccttatcacgaatcataaagtttgtcgcagacgtatcctcatccagcaataaaagacctgctcccgcctcaactgcctcgataagattcgccgcctgagaagtacttccactggcattttctgaggaaaaatctgtagtgtcctgacctgctggaaggtgattgataaacatagatatgtctgtgtgcagcacatttcttccgtcctcggcacgaattttcattccgctattatctgccacgacatactctctgccatccccgcaaatatgattgtatacaccctgttccaacgcctttaacaaagtagattttccgtgatatccaccaccgacaataaccgtgattccttctggaatacccattccagtgacctttcccttatgtggcagttccacctctattctcatagattccggcgaagcaaatggaactgctccacgcattggccggtcggaaactccgctctctcttggcaaaacagctccgtccgcaacaaatgctgtaagatttctcttttttaattcttcccgaaggactttctggtcatctgcaaggaaaatcgcctgttccagatattttttattttttgtatcccagtttcgatagaaaagcgtattttctgctaactgtggcaaaatatcaaatactaacttctgcatctcttttgccagaatcgttcttcctcttgctggaaatcccatctcaaaacgaagttccattttctctttagaaaatacaactgcaatcctttcttgcactgtctggttcgctggacagatcgtgattcttccacttttaccagaacccataaagcccttatcaatctgtcttaactcatataaaaatctccgcaacacctgatcttctaaggctaagcggcgatgcttttcctggtaatattcttctggaaacccatgcctgtccctctttacttcaaaatgaagtcgggatggagaagcgaatgggtctccctgtacatggtcgatatacaaaatgtaattgccgaagctataactgcctccgagcgtcttatacattccataacttttatggtcaattttgatgagttctttttttaaatcttctttatttttcattgttatttccttattttactttgcattcacagttattcttctgatatttttaatagcatcatttttattcaatcatgactataattcacttgatttaaagaaataaaaatactgagattccaacgccccggacaacagccggttcactccaatccagtctccaaatgccgacgtcgcacgttttggcagataattagaatctaataaaaggtatttcttcgtctttttattataatcggaaatggaaacataatgtccctgcacatggacaatggcggtatcgcctgcctttaatttcttcttcagcacgtcaatacttccacttgccccatcccatgcaaaaccatatttttgtccgtatttcttcgctgctgccttaaagattccatcatccgttccgcttcccacaatacgataattcttttctaccgcataattggcaagttccatcacgtccatatactgtccgtttaacgcataaactgcattcactgtcgcaagaattccacagcctgccgttcccatacagcctccgccaccatacggagtcgcacaccattctggatcgtactgagtaaatataaatggtttctttgtgttactcattttctgtgctgcgtgaattcgccagtgagttggctgtgtgcttctggatttttctaaagtaaatgctaattcagtattgctctgctgttttgcatttttcgatgaagtatctgcctgattttcttcaccgctattcgccactttcagttcttcactgtttttcgctgagtcactctcttgagaatcttcgctattttcttttgtatctgtaatctgtcccagaaaatacttacttttcacattttgaatggaaaatgctccatttaaccgctgtaactggaacagcccataagtcttgtccggctgcttcgtccagcaaacaacatactttccgacacttcctttttccgcctttttactcgccgacttaaaggttacggcaagatatttttcagtttcaacattttgaatataatactgattctgtgtcgtatgcattattttaaatgtatactctggataagcttccatcgcggactgatttttacttccccgttttcatcatcctgatagccacatctaaatttgtaaatgccatctgctaatgtctgtttttcacgcccatcatacaaaagtgtgttagaaaatgcacttgctgtcatccagccaatctcataatgatcctttttatcacagataacctgtctgtctccgtctactttgctgataacaattacaccactatatttttttatcgttgtctgtactttagaataacttctacttgtataaatgtacatgtgatctctgactgtcgcatatacatttttatactttggatttacgacaaaagtattaagagaaaaccatcctgtaccagatctttttccacttttgtaattgccgtaaataccatttttacttactttatatgcttctatcgtaagattatttcctgctacttcttcttttttattctttaaattctcatcactataaactgcaacttttccatcctgtatagatgtagctgtcaccggtttctgctccatgtcgtaagggaatgccgcctctgcctttttcccggcacagagcaacaccgctatacaaaataaagaagcaaatacaattctttttatattcataaataaaatctcctacaattttaaattcgccagtgcatctgccaaagcgttattcaacggctgtttctcctcttttttcatcttcttcatataatttgccacatctttctttgaaacacccgctccctctttcttacggcggttttcaaatgcctgcatggattctttatgcccgcaggaacagacaaacttctgcctatctttcgccccgactagctccatctttttatgacaaactggacagcgggcattggtcagtctggaaatacgctctttgtagccgcactctctatcctggcaaacataaagttttccctgttttccgtttactaaaagaagtcgctttccgcactctggacagattttatttgtcagattatcatgacggaatgttcctgttccattctgaatctgcttcatcagttcttttgtatatgttgcaatctcacgcataaacttacggtcacttgccttgccttttgcaatcgcagataaccttgactcccactctgcggtaagttctggtttcttcaaatcttctggcacaagggctaaaagctgttttgccttacttgtaataaagatttcattttcctttttttcaataagataactgccaaaaagcttgtcaataatgtctgctcttgttgcaacagttccgagtccacctgtttcctgcaatgttttcgctgcttttgcatctttttgctgcatatatttgactggattctccatcgcctttaacaaagttccctcggtaaatcttgccggtggttttgtctttccttccgtctttttcagtgaaaaatctctgattacttcaccctcttttaaagcaggaaatactttgccactctcatcgccatccggtgctgttacttccttgtatcctctgtttaaaggtacatttccctctgcaaaaaatgtctcgccctcacattccagtgtgattttggtctgctcgtattcatatggcggatataaaacggcaagaaatcttcgtacaaccaaatcaaaaatctttctctcatccacagaaagctgtgctagaatcactggctgctctgtcgggataatcgcatgatgatcggaaactttctggttatttacaaaagactttttcggtgtgatttttccttttaacactgtatttgtgaagcttctgtacggaccgaccgcaatcgcctccacacgctctcttaatgtctctgccacgtctgttgtcagatagcgggagtccgttcttggataagtcagcaccttatgatgctcataaagactctgcataatatttaaagtctgctttgctgaaaaaccaaatcgctgattcgcatctcttgaaagatctgtaagatcataaagaccctctgcctgagaagtcttcttcgtctttttcacctcagcaacaaccgctgtttttccagaaagattcttataaatctcctcatttttctccttagaaaatgttgctgaacttcctgacttcttatctttccatgtaaaagtaatgcccttgccagtaagctgcaatccataataaggttttggtctaaaatgcctgatttcctcttctcttgcagcaatcatcgcaagagtcggagtctgtactcgcccacaggaaagctgtgcattatatttgcaggttaatgctcttgtcgcattaatacctaccagccagtccgactccgctctcgccgttgccgcatggtaaagattctcatactccttcgcattcttaagatgagcaaaaccgtcacggattgccttatccgtcacagaagaaatccataacctcttcaacggtttcttgttccctgccttcgccagaatccatctcgcaaccaattctccctcacgaccggcatctgtcgcaatgataatctctgcaacatcctttcgttcaatcagggacttcactgcctgaaactgccctcttgtctgaggaatcactactaacttaaaacgctccggcatcatcggaagatcttccattctccatgtcttcaacttcttatcatacccttccgggtccgccagtgttaccagatgtcccaatccccaggtgacaatgtattcatttccttcaatatatttcttcccctgctgtttacaaccgagcacgcgggcgatgtcacggccaacggagggtttttctgcgattactaactttttcatttatataatctcctatataatttccatcttttatccaaaataacacgtttaacctttagtataacataaaattgcaattttgtggcagatagatgctccccagccaaagcacagcccgctggaaaataaataaaccatatttgtgacctcggagcaaagttggatgtgaacgcttttatgcgaacattcaacctgcagcgactaaagtcacaaatatgctttatttatcttccagcgggcgtctgccttgtctatttggtttaactcaaatcacaggcctctcttcttcagcaccctcttttctacgttatagaacaccacttggtcaatgaggattcccaccaccacaatgacaaccattactaacataacctggttaatatctgccagatttcgtcctgtcatcaatgtctgtccaagcccaatggatgttgtcattacttcgccgctcatcaacgctctccacgcaaatgaccatccctgtttcattcccgatattaattcagggagacttgccggaaatatgactttccagtaaatctgcttctgatttgctcccattgtgagggctgcttttttataaattggaggtacatttaatattgcattgtctacggcgattgccatgctgaacgccgatcccatgattactacgaagatgattgctgtttgtgtaagtccaaaccacaagatagaaaatggtacccagcagatgcttggtaatgtctggattcccataatcagtggtcttaagttcctatgtaaaaaagaaaaatggttgattaatattccgattactgctccgattataagtgaaagaatgtatccgatcgcacctcggagaatactgtttccaattgcagcaagtaatgttccctgcttcatcatttccacaaaggaattccacacaccgaccggggatggcatcgcatatgctttccatattccaagtccgtcaacacctgccacatagaatatctgccacaaaatgatgattccaagaaggaacagtatttcccctgctatattggattttcttatttttttcattaataatcccctccctgtatctcttctaatattttatggcgatatgcgataaattcttcatcatagacatgtcttggtctttccagattaattggcacaatatttctgatgccgccattttctcctgacattaccactactttgtcaccaagatataccgcctcttcaacgctatgtgtaataaaaaatattgtcttgtgtgtctgcatccaaatgtcctgtaattcttttcttaaatgattggatgtctgtttatcaagtgcagaaaatggttcatccatcaaaaggatatctgagtccatcgtaaatgctctcgccagggccaccctctgacgcattccgccagagagctgatgtattgcgtagtctttatattgttctaactgcatcatcttcaaatatttttctgcccgtatttcctgttcttccttcggaactccatttattttcattccaaactttatattttggataacattcagccacggaaacagagcatgttcctgaaacatcactgtccgttctgaacccgggccttttacttcttttccgtttaaaagaattcttccttctgtcggagcttctaatcctgcaatcaggttaagcagtgtacttttaccacatccgcttttaccaactacacaaaggaattctcccggctgtatttcaagatttatattttttaaagtggcctgacccgtattttcaaaagtctttcccacattttctaatattaatgccatgctctgtctccttttaaatgtctgatatacgcaataggtactataatttctggatgattaaaattattttacttccgtaataaagtcatcggaaggtttctggtcaatgaatttttgttcaagggaaattgctgcaaaatcatccactgcatctttatttacctctgttgaaatggttaatttctgaaatgccgtctgtaaaatgtcctcacttaatgatttacctgttgccgcattaatctcgtcattaataatttttgccgcctcatctgcattttgattaatttcatccgttgccgcttcatgctgctttaaaaattctttcactaaatcaggatgctcttttaaaaactcatttcttacaacaaccaccgctaccggataattaccttccatgtagactccattgtaatctaacacaatctccgcaccatttttcacaagtgtagaaccccacggttctggtacaagcgccgcatctatatttccctgatccatcatattctgaatatccgcattttctacagcggtaacagtgactgttccgccttcctctactgtctttaacccattatcagaaagaagttttaacaggcacaaatgctgtgtatttccaatttgcggaatggctactgtttttccgtccaaatcttttgctgactcaatctctgaacccggtgcctttaccagttctgctcctgcctgagacgctcctgatataatactgacatctccttttgacttaacatttgcactgattgccggaactggtccaatgtatccgatatcaatatctcctgaaaataatgcctctacctccgatggtcctgcgttaaaagaagtccatttcacttttgcttttccatcaaatgctttgtcgagagttccctgtgctttcatataaagagcctgtgcatgtgttacattattaaaatatcccacattaatttctgttgttttatcagcatcttttttcgttccgccgcatcctgcaagccctgctaccattgctgcgactccggctatcacaaaaatcttttttagattccatctctttatgcttcttttcatatcgaatcaacatcctttccctgttctaattatctatcagcattttttatatcctttccgtctatctttggttaagtgctgatttttacttatctctgtgttattttttctgtctgacatcagcttgtttttcctctcacatgtgttgtatttatcttatgtgaaaatacatttaacaacaacacgattttttgataacgttttctatctcataatattgactttttttcttgttttttttataattttttcatgtatacatgattttataatttatttttcaaaatatttttgataacgttatcaggaggtttttatgtcattaaaagaaattgcccaccgagccggtacttcagtatccaccgtttcaagagtcttaaatcatccagattataaatgcaaaaatccagaactagaggcacgtatctgggctgctgcacaggaaatcagctacacaccaaatactgccgcacaaacattaaaatccggagcacctcaaattaaaaccactcccctcactttcgatatttttctgacccgttttccctcactttctcaggatttatttttcagcgaactttttgaatctctgaaaaaagaacttctacgtcagcaatgtgttcccggaaagtttctcaccctcccggaagtcacttccatgttaaaagaaaaatcctatttttcagtaacagacacccacgctgatggaattatccttcttggaaaatgtcctgctgaactgatttccactttacaaaatcattatcacaatatcgtaggaattgaccgtaacccgacaaactttgattatgacgaagtaatctgcagcggaacaactgccgccgtcactgccatgaactatctcatctctcttgggcataaaaaaatcgcctacataggcgattgctcctatgaggcgagatatattggttattatcaatctttaatttcgcataatttacctttagactactctaatatttatccaaccagccaaaccagagaagagggcatgaaaacaatggaacttatcttacaacgagaagaacttccctccgccattttttgtgcaaatgacagcactgctctcggcgtttttgactgtctgcagcgccaccgcaaaaaaggctacattccttccgttatttccatcgataacatactggaatctgagcagacaaaacctatgctcaccaccattgatattcccaaaaaagaaatggctcaccacgcagtaaacctgctccttgaccggatacataaccaacatagtaatgcggtgcggattgaacttccatgtaggttgattgtacgcgaaagttgttcctattgtgggcgataacttttgagtttcctaccaatgcactactactggataggtggattcaatattgttataaattttctgtactgcgcttctcggtgtatttacacagccgtgagaaccatcgtatgtgaagattcctccaccataacttccacgccaggatgaatcatggattccgacaccaatctgaataaatggaagccagtagtctacatgggaggcatagccctggccagttaaagtataatctgttgttttataaaggatataataaactcctgttggggttccatgtcccttgctgatatcaccagttacaacatctgtggatactaaagtttttccatttttgtagaaccacatatgctgctcacctaagcttacttctacataagtactgccgatatcaaactttttacggctctttgctctgtgagcatattctggttttatcttaacagatttaccctttttaattgttttaacaaggttctttgtttccgctttctgatcaattctccatccgtaagtaccgccactgacacttaccttattgccgcagatggacgtaaaatttcgttttattccaacagtatcgtatttatcagcaagttttttgatatattttgcggccatctcactgtgaactttaacctcatgtttatctgtttcatacagccatttgctgattttctttcccttaagttcttcagtacgatcatcaaagtcgtatgtaattgtttcctgaacatatttgttcatcgttttatttgcttctacgacttcctttgtatccttcttataagcaggatttttatagcagtcatttttttctatatcaatggatttatccatatttaagattgcttcttttaaaagtggtttcagttttttcttctttaccgtatttccgtaaacttccggcacaatactatagctgtttgtagctttatcataggtagaatatgcatcaaccggtgcaactaccatatctttattaaatgcattgagattattatatgtatcattaaatgctgtatcgtccattgtcaatgtaatcgcatctctataatcctgagactggaataatgcagtaatccatgcatagcctttctgctgtgctttaattccctcaagctttccatcatccttaaatgcaagatttacctgagaaaatgaaatactttcctttttcttatttctttccttaattgtaatcttataggctttgatatcttcctttatcatttcttttgtctttgaaacacttcggaaaccacaggaataaccattcacttttgttccgataaaataatgatattgaaaaaatacagaaatagccgcatacaataaaataacaacaagtacagccaggccgatttttttctgtttgttcatttttctttcctcctgttcaaatttatgtactctcggaatctttttatgcttgatttggtgagaagattttttgtcagttgttcccaaatttttgaggcgtacgcgatgcatacgttgatgaaatttgggtgcggctgtcggaaaatcagccacaaaagcaagtgcaggaaatactccgagagtacatattttaataactattgaaataactattagatatagttttttgaatatcaatcgtatttccaaactgtcaaattacctgtccgttaaatatatacgaaatattctcgatatcccacagtctcctagtatagttcatttctccagcagaaacaagagggaaaattgctatttaattcattaagtaacagacgcccgagaagagagaagatatcctatatttgtgactttagtcgcggcgatttaaatgctcgctttatgcgctcgcatctaaaccttgctccgaggccataaatataggatatcttctctcttctcgggctgtctttggctggattttgtttgaattaaatagtggttgtgaggatttgggggagagggcagaagttttctgcttactctcagaatattgtagatggatatttttatctaaattgaaacggtagatattttagaagaacagaagtccactacttgctctgacattattgaaatattacggtgatagtcattaaaaaatccaaatcataccctctattcccagtcattctcgagtaagcagaagacatcagcttctgtccccaatccccctcctgtttaattcaccttctccagcaatggcttcgcctgtagtttgtctaatgaattaaatagtaattctgtatacattttgacgctatatttcttttgtgctatactgattattaataaaaagggaagtcggctctattagagcctatgggggcaatattatgaaaaagacgattaacagaattatgaactcgtatattcagttctttaaaataaagaatttaaacgttcagattgtactgacagacgatatgtatacctgtcagaaaaaatatggatttaataaagaagactctcagactcttgatgaggcaactgcccgcaaaaactggaagcatgtagctgcctgtatgaaatatccaaagcatatgaacgagccgtttacactgatttttaaggaaccatatttaagacgttccccactttgtgaagtatatcgtcttgtcttccatgaactgacacacatttgtgattatagagactatgcccgacttaatcacctgacttcctacagacagttatttgatgacccggaaacagtattgttccagcactggtctgagtatcacgcagaacgccggggctatgccgcatggctgaaacaccgctacggtattcgcgttaaatacgacattaacaatagtaaagttgatatcttacataaagaaacagtaagtaatattcagtattacggcgagcattacaccaacaccgccgaatacggctctacccgccagatttattttacaatgcatcttctggctcgtatgagtatctggatgcagattcttccttatcagatgagtgatattttatcgaaagacccatttgattataagggaattgagtggattaagaagctgatgtatcttttccataagtatccgaatattgatcagatgaatgatcattttatggagattgctaagattgttgcggagaatttttcactttccagagaggaaatctgggaaaaagtttcttgataaattctgatttgccgcaggcaaaggagactcccccaaagagagaaggaatataacgatggaatttttagatataagagataaaaatgggaatcccacaggtgaagtaaaagaacgttccttagttcatgccgatggagatattcatggaacttctcatgtatggattgtgcggaaaaatgaaaaaggcagttatgatttgctgttacagaaacgtagtgaaaataaagatgcatttccaggatgctatgatatttcttctgcaggacatttaccagcaggtcaggattatctttcttctgcattaagggaactggaagaagaacttggaattaaggcaaagccggagcagcttcattttatgggactccatgagggatgttgcgaggaaacattttatggcaagccttttaaaaatcacgaaatcagtcatgtttatttgtatcaggaacctgttaatatagaagatttaaccttacagaaagaagaagttcaagaagtatgctggcttgattttaaggaatgctgcaaaaaagtaaaagatggagatagaaagtattgtctgtttccagaggaacttttgatgataaaaaaatatttacaattctatttaaaataaaaaaaacgcatcgacgtcatcaatatgactcgatacgcaccatataaaatctgcaaagcagttaaaggggaaaattaagatttatatttaaggtctcaccgcaatggctcaactcttcttttcaacgtttcttattatataatatttttcttttttttcaattcacaatcttcacaaaaaaatttagttttacttcttttttgttaggcgatttcacatcctattgaagtttattatcaaaattgccctcaattcctgctttttatctatttttattgtatttctttttcttaacctcatgtcaaaaaaatttctatttatgcccgaaaaatagccgaagtcaccgcattatcctctattcaaactgattttcttttgttataataaaataacagaatttaagttgggagggaagcagtatgcaacatatgacgttaaacaagatttctattgaacacattacactcgaacatatcggttttgttcatcacggattcggcgttgacttacctgattatcttctgtaagagtcgtttagttttattaaaggaaacggaaccgaaagaaggcattatgtaaaactacttcgtatcactgcacgataaatgctcaaccgcatctatcgcttgctagagcgtgttattacataatgccttctttcgattcctgtctttaacaaattactatttaatactcttcaatgccaccattccgcctctcttatacatacccgtattccaaagtcttttaaaatcaacagacagagcttctccatatgtatgataatttaagtaaactctttcttctaagttgatgccttctttaattttatttttattcatttcatttgcctgaatggaagctgtgtggatacaagaattttttatttgacgctgctggacttcttctttttctgttttatatcctgttatacaaaaccaatgccaattcagatccttaaattccttatcccgatgacgaagcatgagataaattaccggaagatttctctcgattgcttttttcacaaatttctcagcttcttcatatggtttatccccatctagagtctcaaattcagccccatatccacaatcctttaaatattgtccacacccatctgtaaacatagaaagttttgtgactcctccgactcttggatgaatatagggtttcattttcatggagaagtccacatattcttttctagtgagatttaatgcatcgccgggataacattttttcagaccataatttctcgccaggcaaatagataaatcgcaggcagctaatgcaccacagccgccaagatacatccagaagtctgtgcaccattcctgattgccgccgggggttccttctatctgaaaataatcaatatttttttcttgtttcataaagtattcctcatttattacttttccaacttctatattttcttgttatttctcatatagtctttattatgtatacaatagctattaaccagtagttcttaaacttatcttaattatagctggtcttttatatcagatgtaagatgacgcacatcttgcagaaagcatttttcaaacaccctctagtaattacgcttaatactatattgattaaatcacataatcaattccgttattgccacgctcgccaccgctcctgctatcgtcgcaaacatcgctcccggtaaagtccaacgtgttttttttatatttacactcatgtagtaaatcgtaattgtatagattaccgtctctgtacaactcatcatgattgagacaatcattccaagccttgaatccggaccatattctttaaaaatatcaaggacaaagctgaccgctgccgatgaagaaaatattcttacaataaatacgggaataacttctactggaatgtgcaaaagctttcctgcgggagcaagcagttctgagaaagaatctaatgctcctgatgcacgaaagattcctatcgaaacgagtaatgctatcattgtcggcgcgatttcaataacaatctgaaaaccctcttttactccctttagaaagctttcatatacatcggtgcgattaaagaagccatatacaacaatatagaacatggtaaatggcacgataaaatccgaaaaataaagaagaaacttcactgtatccatctccgtttcttcttattttttctattatatttctttccattgtatcttgttatttctattattttaatgaatacaattcctgctatggtagaaatcattgtcgcacagattgctggaagtacaaccgcggctggattcacggaaccgtactggcttcgataggcaatcatgttaattggaacaagctgcagcgatgaaatattcaaaacaagaaaagcacacatcatatcagaagctctgcccccgccttcctccagcttctgcagctctcgcatcgccttaagcccagctggggtcgccgcccagcctagcccaagaatattagctgccatattagccgctatgtattcattagctttatggcggggtggtatgtctggaaatagccagtggataaagggatacattgtctttgcaatctttttcataagaccactctttaccgctatttccatcatgccgttccagacaccgataactccaagcataaaaatacataaattcaccgcctctgttgaagatgaaataaaactttctgttatctgccccattgtgccatgaaatgccgcaaagaagattcctccggcaatcataatcacccacaatatattcagcataaaccactcaaactctctcaacctttttcttcattatattgttcctggcttgtacggtatgcttccatatcaaagtaaccaaactgattcttaacggtatgtttaatctgatacatcgcaaaatccgcatactgcataaatatcttgctgtctgtcgtatcctgtatgaatgtccattatctatcttttatacactctaggaactctctttcctacatcacaaacaaattcatagttaaagcttccggcaaggttcgccatatcttcaacactgatataattatccccgtcttttccaatcaaggtaacgatatcttcaagcttcacatctggaatatctgtaatgtctaccatcatctgatccatgcacactctcccgacaatcggtgctttctgtccgtgaatcaatacccagcctttgttagaaagacttcttgcatatccatccgcatatccaacagatactgtagcaagacggcatggatgttcaacaatataagtcgctccataacttacacctcgttccatctctggctccataatatttactacatgagaataccagctcatggccggtgtcagatctaaattagagaaatccacttcatcagaaggatacattccataaagaataatacccgcccttgccatatcataacgatggtcttcatattccatgatagcggcactattacagatatgttttactggaatttcaattcccgcttcatcaagtaactgaacaaaatgatcatatctctccatctgactttctgtgtatgccttatctgtcatatctgcacaggataaatgggtaaataacccctcaatctttatattgggcagctctgcaatctgctttacaatcgcaagccctttctcatctggagataaaccgattcttgtcattccggtatctaatgcgatgtgaattctcgccgtcttttctgcctttacggcagcttcagacattgccttagccgtatcatagcaataaatcgtctgatctacaccatactccaaattcttataataaagagagggggaattatagccaagaagcaaaattggctgttttaatccagcctttctcagttctactccctcatcaattgtagcaacaccaaaataatctgcaatatcatttaaataatgtgctacttccactgcaccatgtccataaccgtcagcctttatgacagccatagtcatcgcattatctcctgttttctttttgatatttatataattctccctaattgcttttaaatcaatttcacaataggtacgcaagtattcttccattatgtttgtcctctttcccttacttctacagtaatcctgtaaaatcatactttactcaggttactgtacatatctatattatgtcacatttggtatacttataaatgggcgcaaaacaccccttataaaaaagtctgtaaacaaataaattctaccacattttttcctattgtgaagttttttatacagaaaaaattcgggaaatatagcatctcccgaattctttcaattatttcacttttactattttacttttactataattactttcttttttccatcactggtctttacagtaattttacatttaccttttttcaaggccttaataacacctttttttgttactttggcaatcctcttattggaagagcgatacataatcttagcagtagaagatgctggaatcttcttggcttgtattttatatttctttcccttctttaaagtaacttttgtcttcttcacttttaaagactttgtttttattgttttcttaactgtagaacctgaagctggcttcgtctctggcttcttttcggatgttcccggcttcgtatttggcttatcttcagagctgcctggtttcgtattatcctcttcatcagaaccatttacttctatcacatacttgctcacatctggaacttttgtaatacttgaccagtacaactcagaaattgttccatagttatccttgatttccttaccgtttagcaatgtccgattggatgtcttagcaagcgttaccccatctgcaattgcttttcccgcagtagcacctgtttttggtatactgctgcatccaccttgtgcataaacattttttacagaaacagtaccattaccgctgatagcatctgcgccatcatcatatgtaccgttaccgccaaatgcaattaatgttccctcaccggaaatacttccattatctaaaataattccgctgccgcctacggatgttgttgcaatatatcctccaccaaatgccgctactacggaatcctttttaatatctaaagaaccattctcaatacggatcgctggctgaccggaaaggctttttcctgttgtttcatcctgtccggttgctgcttcatctccctttacaaatacctgcccatctacggtaacctttccttttacaacaataacaggattcgtattctgtctgatgatatgtccatttgatataaaattggtgttagaataaatagatgaattttctaaaattgctccatcatttaaaatcaactgtccattaattgaagaacctgtgagaaactgactgccataatcatcatagtttgatgagaacttaccgccatttttcacttcaatatttccatgaatagaagaatcacgaagaacaagctttccgccattctctacaacaatatttacgctgctgaaaactttcatatttacaagagtaagattacagccatctggaacaatcaatgtctgtactggactaccatctacagcataaccaagttctccataagttccacttgtatgagaaccgtaccatgctttaatatcctttggtaccgtaacggtttcgttctctccaccaaaagaagcgattgcccatggctccatatcatacatatactttccatccgctgtctgcttacaattctcaagtttaagctgctttgcaagtacttctgtacgagtataaactttaaaattcagctcattacttgtcgcagtacgaccgctctcatccgttactgttacactaattggataagagccggcttttaacggttcccctgataaagaaagagaactgtcgtggacagaataaacaccttccattccgcaggcttctgtatcaatatttatctttgttctgttcttatttactgtgattacttcacttaacggcttccagtcgctgttcttcggctcctgtccatcaggaagaactgctgcttcaacaatcacatcactatttttatttgtcgtaacagaagtagaagctccactgattgcatcatatttcttctgtccttctaaagcactttcaaagcttcctcgtattcttacatgaagcgtattaattccatcagaaggtcctgaaggagtctctgcatctgaatctgtctttttaacagtaaatgtatctgctgttgcctttatcacacgtaagtacagcgtttcatatccttcactctcaatcgtgagaatatttccactctttaacatgccgtcagaagaaccatcaaaataaagtttattttcatctgtatttctgtagtatgcttctcgtctcattaaagataaacgagaacttgcttcttcccactttgttttatttacagaaacactttttattcctttgacatagtcaggtgcatccgcaaaagaaagactctgaaaatcataaactacattttctttcattgcttctacattgccgacactggcagaatttgcagagtttgccgcaaatgaaggaataaaggataatgcaagtaaacacactcccaaaactacactagctaataaatttctaaccttcctattcatatccggtttctcctattttacagttactttaacaactgctttctttccacttgctgtcttaacagtaatcttgcatttaccttttttaacggcctttacaacaccgttctttgttactttggcaaccttcttgttagaagacttaaaggtaactttttctgtcgcattggctggttttaattttactttaagtttaacttttttgcctttctttaacacaatacgctttttgttaacaacaactttttttgcttttacagttttcctatctggtttttctgctggttttgtatcatcttttttaccttctgttgttttgtctgctggcttaggatcttcttgctttaaatctccatattctgctccacatacttcacagactgctctctttgttgttgtagcttcgccacctttatgtgcttctttttcagtcgtagcatcacaaccttcattctgacatttcttccagtgataagttccgtcagactcatattcatctccatagttatgagatgcgcactctccgtattcttctccacagaaatcgcagactgctttcttcgtacaagtagctgttccgcctgtgtgttttgtgtggatggcaactgttttaccatctttatttacttccaatactaagtctttatatccatctgcagaaataacaactttattaactgctgattcatctttttcaaatttgccctctccaattaataggtatcttacatccgtactatctgaggaatcaagcgttgccttagcataatatttcgcattgttccatatactataagaagaagttgctttttcatactctattccatttacttcaaccttatcaattgctgaaagccattcttcagcatcatcgccataattcaattgacaatcatatccagcaactgtcttatatgttgaaggagcttttggtgcttcctttaattctaccgttgctgtctcctcagcctgtaccgctacctgtggtgcaactgttcccactactgtcattgacaggcacattgcacatgccataatgaatgaactaatttttctcatttgtttctctccctttctctctctcaaataaacttaataaaaaaacaggtttccatttaaaactaatttatgttactcaattctaacatcggttagtttatttaaaagattacctgtttttatactccctgtcaattctacagttgataacatttctcaactatagaattcttaagaattcatttatttaatttttagaaaaaaggattacttttttaacagttcctgataaatatcccttttacttactccgcggtcttttgctacctgtttcatcgcactctttttatccatccctttttcaagataatgttccatatgttcctgcacagtaagctgattccactcctgttgtttttcttctttcagttcctgtaaactctttccctcaaagattaaaacatactcccctcttggctcgttctcctcataataagcaatcatttcatcgagagttgccttgcgcttctgctcatatcgcttcgtcagttccttacataccgtcatatttcggttaccaagatattccctgcactctttcaaagtcttctttaaatgatgcggcgcttcgtaaataataatcgttcttgtctcattgcgaagattctccaaaatctgtgctctttccttcttgtcatacggtaaaaatgcttcgaatgcgaatctccttgtcggctgtccggacatagtaagtgccgtaatgcaggcacaagctcccggaagtgatgtaacattaattcccgcttcatagcactgtcttacaagttcctctcctgggtcagagattcccggtgttcccgcatctgtgattactgcgatatccagtccttctcttaatttatttacaagataaactgccttatcgactttgttgtactcatgatagctcgtcatctttgtttttatctcaaaatgattgagaagcttgatactgtttctcgtatcttctgccgctatcaaatccacttcttttaaaattcgtactgcccgataggtcatatcttcgagatttccaatcggtgtcgcacataaatataatgttcctgccattttaattcttcatttctccatatatctgataaatctcatcggtataagaaccatccttattgtatacaattaatggggttctaccgtaatcctctgcttaccaccttttacaacatcaatcaaaaccatatttggctctttatctacataaggatgtacgagacgcatcctcttcggctctaatttatgctgttttaatgtataaataatctccgctaagcgaaaaggtctgtgcaccatataaaaatggccgcctgttttcaacagccattttgctgcatttactacatcttcaagggaacaggtaatctcatgtcttgcaattgcctttgcataatctggattcgtcagaccatgttctcctgtcatatacggagggttacaggtcacccagtcaaaactctccctctcatagtctgtctttatattacgaacatccccctgtacaatatgcactttttcttcctgaccattcatcttcacagaacgctctgccatcttggcaaactcttcctgatactctaaaccttctacatgagcaagcggatatttaccctccatcagtattggaataattcctgtaccgctacacaaatcaatccctttacttttctttttaactctggcataatcagaaagcagtaccgcatcaatcccgaagcaaaaaccatctgttttctggataatacggtaatcctttatctggagatcatcaatacgctcattttctttaatttgtacattctccatataagtatcctattttaaatcttcattttcaactacaattaagtgaagaacctagtaattaaactaccgaagaactcttcttaatttttcaaacttcttatatcaacaaaaccaaaatttgagtattataaaaaattatgaggaataaaacaataataataacagtaattgttattattcaaattcccttcccttattctcctcgtttcattaaagcttagactttctttccttcttctccatcgcctctaattttttaagctcatcatccatttttactttttctctgcgcttccgaggacggaaaatcaaatcatccactttataatctacgagctccttttctcctttttcgtcagtaactacgagcttcactctctgtcttaacacgctgacttcgtgaacaacaccttttactcccgtattcgtctttacttcatcaccaacattcggaagcttactgttcagatactcataagtatcctgctcatttttcagacagcacatcaatcttccacaaactcctgaaatctttgtaggattcagagaaagattctgctccttcgccattttaattgatactggcacaaactcagataaaaatgtattacagcaaaggcttcttccacaaataccgataccacctttaatttttgtctcatctcttacaccaatctgtcttaattcaattcttgtcttaaaaactgaggctaaatcttttaccaactcacggaaatcaattcgtccatccgccgtaaagtaaaataatactttattattatcaaatgtatactcacaatcaatgagcttcattgcaagcttatgtttttttatcttctcaatacagattttataagcttctttgctcttttctttattattttcctgaatcttatcgtcttctggtgttgcgattcggataactggctttaaagttgcaataatcttctcatcgtgaatctcacgatttcctaaaacaactctgccgtattctactccacgcgcagtctccacgataacattctgtccaacttctacctcaaactgctctgaggcaaaataatatattttaccattatctctaaaacgaactcctattactctggccatttctacctcctgttcttcttaaaactctcttctcgcttctacaataagcaactctaaagttgcgtcaaaattcacattagactttatgcggactctggcacgatgaattttgcctataacataatcaattgcctctaaatctaatttatctacctgctttttcagatacgcatactcatttttaaaaataattttctttttggcagcttcagcattcactgaattatctgctttcagtaacataatatcccgaaaccacatcagaaaaatatcgaaaaagtcctcaattctgtttttatactttttatattcctttactttatctgcaatctcgtaactctctatctcatggatataccgcaaaatggacagagtcaactcctttaaatcctgaaattcttctgaagaaatgattgcttctgcctttcctatatttccaagagaaaatcctgctgcaaattctgcttcttccttagaaacactacatttttccaccaagtatttctcaacagctgttccgggtaccggtcttgtggcaagaagaatacatcttgaaagaattgtgtctaaaaatgctcctctgttcgtagtaagtaagaaaataactgcatattccggcggttcctcaatcgtctttaagatggcattctgcgctgcagcattcatcttttccgcctcatctacgatatagattttataaggccccttatatggcataatttctactgtattaacaatctgctcccttatctcaccaacactaatcacattgggcttttcatgagaaacccaaattacatccggatgatcatggtattccatctgtatacaagattcacactttccacaggattccaccagacccgtagtttcccggccttcacactgcaatattttagagaaggcctcggcaagcatttttttcccacttcccttatccccctccataatataggcatgagaaatctttttatgatgcacagcagtaataaaatgctcttttattctttcatttcctaaaatctcatttaattcagccatgactttccctcaaaatctttctgttaatcatcttaattcttctgctaattttctattggtacctattcttttattgttttttctcaatgaattcatgtctatcgattcttcttcttcaataattcatccacatgattccgaatctttttctgaatcgtatcaatggatcttccaccatcaatcttcataacttccggcctgcctgaaaggacttttcgatatccttccgataccatatgatgaaaatctataccttcctgctccatacgatcaagattcttctgctctttctttctacgaagtccttctgcctctgataaatcaataaaaaagattccatcgggacgataaatgccgattcccggcgcatttacagccgaaactgtagaaataccaagttttcttgcaattccctgataaacgatagaagaatctacaaaacgatcgcttataacgattttgccctcttctaatgctggtccgattacttcatgtactaactgcgctcttgatgccgcatagagaagcatttctgttactggagacatttctttgtgttctggattcagaataagctgtcttatttcctctccgatcactgttcccccggttctcttgttatgagacattcatagcctgcttcctctaagtattcttttaataaatttatttgtgtggtctttcctgaaccatccggtccctccatcacaataaataatcccttcatctaataaaatctcccttcagaagtacatgcacttttattatctgaatgttatctgacttcttcatcgtattttagtcatagtactttcaaacatgctctggtacaatatttttatcatactgcttttgctatactatctataaatcttttagaacgataatcttattacaggacaatccaagtacattatatccattatataaatattgactgatattttccactgtttctttgagtattttttctccaggaactaatattggtactcccggcggataaatcatgacatattttcctgaaactctgccagtagaatcagccaactcaactgtctccatggcttttccccggcactgccaggattctatgattttgggaggatatattgtctgctcattttctttttcttgtataaccttatagtggttatgaattttagtttctattttgggtttgtttttatcacaaatttctatttcaactttatcttggttttggatggcaatttttgtctcatttacagccttatttaaactacgattttccttttctttctcttcacacattttatcaatctcagaaattgccttccaaagctcatcaaaatcttcctttttatcacagatagaagtcatggcaatcccataagtcaggttctccatctccagttcaatgtgatatttttcatataataactgaaacagctcctttccatttattccgcagccctttactgaaaagaccaatttcccgttatcatatgcaaaacaatttaactttttctgattgagcaggcttatttttttgagttgttcacattttcggcgaaaatttttaaggttatccacatattcggcgagttgtccctgattttctttcatatacatgattccgtactcagcagaagccatcaaaagatacgatggacttgaggtttcataaatatcgatgatttcctccacctgctcttttgtcacgatgtctgagcaaagatgaagaactgctgtctgcgtaaaggaaggcaatgttttatgcgtactttgaatcaccaagtcagcaccttcctgaacggcactgtctggaaaatacttatgaaatatgagatgcgccccgtgtgcctcatctacaatcaaaggaatggcatacggccgagttacttctttaatccctgctatgtcgctcacaactccttcataagtaggtgaagtcagtacaactgcctttatatctggattcgcccttaattcccttgctacggcttctggcttcatatcctcgcatatatcatactcggcagaaacatctgcatagcaatagacggcctccaactgtaatagcctgatacagttatagaccgccttatgacagtttcgccctattaaaatcttatctccctgtctacagaccgaagaaatggataccagaatcccaagggtactccctccaacaagataccatgattccttacttttaaatatatctcttacaagattcatggattcacgaataatgccctctggctcatgaagattatcgtaatctgttatctctgtaatatccattttttctacaccaaaaaaagccccaaaatcagctcttttgtgacctggcatatgaaaaggaattcttttttctgactctaattctcttaatttattatagattggtgtattcataacttattttttatctcttcatccttttaactcttcttagaatttatgctttttaaatttattaccacttaccagccgactattaataagcttattagacaaaaaaaatagctcagtaaataaaacatttactgagccttcatgagacatcggggattcgaaccccggacaacttgattaaaagtcaagtgctctaccaactgagctaatatcccatatgcccagaaccggaatcgaaccagtgacacgaggattttcagtcctctgctctaccaactgagctatctgggcatgagttgcgggggaaggatttgaaccaacgacctccgggttatgagcccgacgagctaccagactgctctaccccgcgataataattattaatttttaaatgggcggaggtggattcgaaccaccgaagcaatttgcagcagatttacagtctgtcccctttggccactcgggaatccacccatatttaattatgacttttaataaccataacaagccgatgaacggactcgaaccgttaacctgctgattacaaatcagctgctctgccaattgagccacatcggcataaatgggacctataggactcgaacctatgaccctctgcttgtaaggcagatgctctcccagctgagctaagatcccatattcacttattaaaatatatccttgcggataaacgacccggatgggattcgaacccacgacctccgccgtgacagggcggcgctctaaccagctgagccaccgggccaaaaaggtatgtaccttcaaaaccacacacaaactatctttttccattccaataactctctaaggtcaagctttcgaccgattagtaacagtcaactccacacatcgctgtgcttccatctctgccctatctacctcatcgtctctaaggggtctctcactctttcgagtatggatatctcatcttgagggggcttcacgcttagatgccttcagcgtttatcccttcccgtcttggctacccggccgtgccattggcatgacaaccggtccaccagcggacggtccatcccggtcctctcgtactaaggacagctcctctcagatatcctgcgcccgcgccggatagggaccgaactgtctcacgacgttctgaacccagctcgcgtaccgctttaatgggcgaacagcccaacccttggaacctgctccagctccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctactttcgtacctgctccacccgtcggtgtcgcagtcaagcctccttctgcctttgcactctccggatggtttccaaccatcctgaggagacctttgagcgcctccgataccctttcggaggcgaccgccccagtcaaactccccgcctgacattgtcccccgcccgggtcacgggcgcaggttagaaacccagtactgcaggggtggtatcccaacattggctccctcacggctggcgccatgagttcttagcctcccacctatcctgtacatgcaataccgaatcccagtatcaggctggagtaaagctccatggggtctttccgtcctggcgcgggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcaaaccttcgctcgcgctaagctctccccttaaccttccagcaccgggcaggcgtcagcccatatacctcacctttcggtttcgcatagacctgtgtttttgctaaacagttgcttgggccatttctctgcggctgcttgcgcagcactccttctcccgaagttacggagtcattttgccgagttccttaacaacacttctcccgccggccttaggatcctctcctcatccacctgtgtcggtttacggtacgggcccttgctacacgatagcggcttttctcgacaggaaggggccgcagcttcactacttcatttcgctccgcatcacgccttcgtctcatgcagggcggattttccaaccctgcgactacttcgcttgcaccgggctttccattcccggctctgcttcccttcccgtgtccccgcagttctgataacaaggggtgcaggaatcttaaacctgctgtccatcggatacgcatctctgcctctccttaggccccgacttacccagagcagatcagctttactctggaaaccttggatattcggccgcaaggattcccaccttgctctcgctactcattccggcattctctcttcttagcggtccacatccccttccggtaatgcttcgctcccctaagaatgctcctctaccaacccttacgggttccgcggcttcggtgtggtgtttcagccccggacattttcggcgcaggacctctcgaccagtgagctgttacgcactcttttaatgaatggctgcttctgagccaacatcctggttgtcttagagatcccacatccttttccacttaacacccactttgggaccttagccggcggtctgggctctttcccttttgactgtccaacttatctcgtacagtctgactcccatacaccatctgtccggcattcggagtttgatattctttggtaggctttgacgcccccgcggaaattcagtgctctacctccggcagacttgtatgaggctagccctaaagctatttcgaggagaaccagctatctccgggttcgattggaatttctccgctatccacacctcatccccacccttttcaacggatgtgggttcggtcctccatcgccttttacggcggcttcaacctggacatggataggtcacccggtttcgggcctgcacgtactgactaaaacgccctcttaagacttggtttccctgcggctccgcacctgaagtgcttaaccttgccagtacccgcagctcgccggaccgttctacaaaaagtacgcggtcgtacttaagaagtacttccacagcttgtagacacagggtttcaggttctctttcactcccctcccggggttcttttcacctttccttcacagtactatacgctatcggtcactgagtagtatttagccttacggagtggtctccgctcgttcccacagggtttcccgtgtcccgtggtactctggatcctgccgggtcagctctggcttcggatacggggctctcaccctctctggccggctgttccaaagccgttctcctgccgttactgaatcccttatgcagtccgaaccccgcgatgcacgcatcacggtttgggctcttccgcgttcgctcgccgctacttacggaatcgatgtttctttctcttcctccgggtacttagatgtttcagttccccgggttcccttccataagctatggattcacttatggatgactgtagtccatacagccgggtttccccattcagagatctccggatcaaaggatatttgctcctccccgaagcttatcgcagcttatcacgtctttcatcggctctcagtgccaaggcatccgccctgcgcccttcttcgcttgacctttgtatgtccatttcctaagaaatggctgcctcctgttcctcctagcgtagagaacattcggcgtatgagttaaaactcatgtttcgtctttcgacttgctattgggagaattgatttagtctcaattctttcttatcatagaaatctgatgtcgcttttcttttaagaaaaactatctgtgtgcagttttcaaggtacatcttccacttccgtattgccacacctgcttggtcccctcaaaatcaatcaaaagattttttaaggaaccgggcagccacctgctctcccatgccgtctccagcatagtaccatcggccgctcaggtcttaaccatcgtgttcgggatgggaacgggtgtgtcccctgagcgcatcgccacccggaagggcgttatcaagttttcacttggtaactgaataacaaaacaactctctacttgtcttccttagaaaggaggtgatccagccgcaccttccgatacggctaccttgttacgacttcaccccagttaccggctccaccttcgacagctccctccataaaggttgggtcactggcttcgggcatttccgactcccatggtgtgacgggcggtgtgtacaagacccgggaacgtattcaccgcgacattctgattcgcgattactagcgattccagcttcgtgtagtcgggttgcagactacagtccgaactgggacggcctttttgtggtttgctccccctcgcaggttcgcctcactctgtgaccgccattgtagcacgtgtgtcgcccagatcataaggggcatgatgatttgacgtcgtccccaccttcctccaggttatccctggcagtctctccagagtgcccagctctacctgctggctactgaagataggggttgcgctcgttgcgggacttaacccaacatctcacgacacgagctgacgacaaccatgcaccacctgtctcttctgtcccgaaggaaagcaccgattaaggtgcggtcagaaggatgtcaagacctggtaaggttcttcgcgttgcttcgaattaaaccacatgctccaccgcttgtgcgggtccccgtcaattcctttgagtttcattcttgcgaacgtactccccaggtggaatacttactgcgttagcggcggcaccggagcctatacggccccgacacctagtattcatcgtttacggcgtggactaccagggtatctaatcctgtttgctccccacgctttcgtgcctcagtgtcagtaacagtccagcaggccgccttcgccactggtgttcctcctaatatctacgcatttcaccgctacactaggaattccgcctgcctctcctgtactctagccgagcagtttcaaatgcagctccggggttgagccccggcctttcacatctgacttgcactgccacctacgcaccctttacacccagtaaatccggataacgcttgctccatacgtattaccgcggctgctggcacgtatttagccggagcttcttagtcaggtaccgtcattatcttccctgctgatagagctttacataccgaaatacttcttcactcacgcggcgttgctgcatcagggtttcccccattgtgcaatattccccactgctgcctcccgtaggagtttggaccgtgtctcagttccaatgtggccgttcatcctctcagaccggctactgatcgttgccttggtaggccgttaccctgccaaccagctaatcagacgcgggcccatcctgtaccaccggagtttttcacacaaggagatgtctcctcgtgcgcttatgcggtattagcagccgtttccaactgttatccccctgtacagggcaggttacccacgcgttactcacccgtccgccactcagtcaccaatcgatcatccgaagaatctcaaaaggtgcttcgttcgacttgcatgtgttaggcacgccgccagcgttcatcctgagccaggatcaaactctcaaataaaatgtttaagatgtcagatcaaggtccagaaccactggttcttttcctgtcattactgtttatttaggttttgaactttcgttctgttccatggactttcctgcagacatcactctcaggaaaacccgaatgaaatttgaattaacgttcaaggttgttttgttattcagttatcaaggttttgtgtcgttcttttttttgtgacacaacttctttattttatcacattcagaagtctttgtcaagaacttttttaatttattttttaatgttttgttgcttttcttgagcaactcgtacattctatcacattcccattcatctgtcaagcatttttttatttttcttctttattttccaaataagagtgaaaaatattacggagaaggagggatttgaaccctcgcaccgcgcgaacgatctacacccttagcaggggcgcctcttcagccacttgagtacttctccataatgcctaaataaataaaaatattcaattccgttgcacactgatgcacaacgctttattatattagcaaaaaggctgacaaaagtcaagcctttttttaattattttttccatttttcttttgcagtctcataaaggttgtttccatctttatcaataactacaataacaggtagattttcaatctctaacttacggattgcctctgtgccaagatcatcgtaagcaattacttctgccttcttaatacatttagataataatgcacccgctccacctactgcggcaaagtatactgcaccatttctcttcattgcttctataacttcaggagaacgctttcctttacctaccatgccttttaatcctttatcaagcatctcaggggtatacttatccatacgactgcttgtagtaggccctgcagaaccaataacctgtccctctcttgccggacttggcccaaggtaatataaaacattgccatttagttctataggtaaagattcccctttatgcatactttcatacattcttttatgtgctgcatctctggcagtataaataattccagacaggtatacatagtcccctgcctttaaagtattaatatcttcttcagaaagtggaacctgaattgttttattcataactgtatcctccccttataaagtccttactgcatgacgatttacatgacagcacatatttacggcaaccggaagtcctgcaatatgcgtaggatatgtattaatgttgacagcaagtgctgtaacagttccaccaagtcctgctgctccaattccaagattatttaccttttcaagaacctcttcttccattgctttaatagaaggaaactcggaatgagtacccacaggtcttgtaagtgcctgctttgccataagagcagccttttcaaatgtaccgccaataccaacaccgacaacaactggaggacaggcatttggtcctgcttcccgtacagcggatacaatcgcattcactgcaccttccataccatctgccggtttaagcataaatacacggctcatattttcacttccgaagccctttggtgctacagtaagcttaatattctctcctggaacaatgctgtaatgaataacagcaggagtattatcttttgtattttctctgataaatgggtcatttactacagatttgcgaagatatccttctacatatccatcatgtacccctttattgatggcatccgtaagagaaccgccctcaatatgtacatcctggcctacctctgcaaatacaactgccatccctgtatcttgacagattggaatctgctctactcctgcaatatcaagattctcttttagctgattaagaatctggcagccaagagggttctcttcctgttctgccgctttgtataaagcattcttcatgtcatctgaaagatagtaattggcctcgatacacatttctttaatattcttagaaatttcctctacgttaattactcgcatctttatacctctttatccgtttaatccacagatgataaattattgaaataaaatcaaaataatcaaatacatctgtggattagtctggggcaatccttagtcaataagagctggtaatctttctccctgcttactgacttttattaccctgtatgaaaaatttaaacttcttctggtgctgtttcattttctatggcttcattctcatctgatacagtctcttcagatacttcagatatatcttcttccatatcttcagactcatcctcttcctggaatcttacctttgcaacactggcaactttaatatcgctgtctgcatcaatattaatcagcttaacaccagaagtatttcgaccaataacagaaatagaatcactcttcattcgaatcacaattccctctgtcgtaataagcataatctcttcttctggcttaatcgtcttcactccgataacatagccggtcttctccgtaatcttataacatctaagaccctttccgccacgatgctgtacggtaaattcatcaagtggagtacgtttacccatacctttttcagatacgatgagtaaatcatctccttcagaatgaatctgcataccgactacttcatctgtatctccaagattcattccgataacacccatagaaactcgtccggtttctcgtacatcctgaagcttaaagcggatacactgaccttctcttgatacgaggaaaatgtcttcgttctcatcggtctgttttacttcaataagctcatcgccttctcgtaaggaaatcgcagccagaccatttttacggacgttcttatactcatcaaatcctgtcttctttacaataccatttctcgtagccataacaagataatgctgctttccatcttctgataatggaataatcgctgtgatcttctcttctggctggagctgaagaagattgatgatattcactcctcttgctgttctgctggattccggaatctcatatccctttaagcgatatacacgtcccttatttgtaaagaacatgatgtagttatgagtgcttgtcatgaataaatcttcgatatggtcttcatcgatcacattcatacctttgattcccttaccaccacgattctgactgtggaagttatccggtgtcatgcgcttgatatatccaagtttggagaaagtgataatcgcatcttttctagggattaacgcttcatcacttaaatcttccatatccatttcgatagaagttcttctgtcatcaccatatttgtcgcgaatgagaaggatttcctcgcggattacacctaagagaaccttttcatctgctaaaatggcttctaactctgcaatctttttctcaagttcatcatactcgttctgaagcttctctctctctaaaccggtaagcgcacgcagacgcatatctacaatcgcctgtgcctgtgcctgagagaattcaaaacgcttgattaagttatctcttgcctctgctacgttcttagaagcacggataatctcgataacttcatcaatgtaatctaaagcctttaaaagaccttctaaaatgtgcgctctctcttttgccttgttcagctcgtattttgttcgtcttgttacaacatctttctggtgattcagataatgaacaagcatttcttttaagttaagaacctttggctggttatctacaagcgcaagcatgataacaccaaaagtatcctgaagctgtgtatgtttaaataactgctttaataaaacattggcattcacatctttacgtgtctcgatacagatccgcataccgcttctgtctgattcatcacgtaattctgtgattccgtcaattctcttttcctttactaaatcagcaattttctcaattaaacgtgccttatttaccatgtatggaagttctgttacgataattctctgctttccattcttcattggctcaatatttgttacggcacgtactttaatcttacctcttccggtacgatatgcctggtcgattcccttacgtccaagaatagccgctcctgttgggaagtccggaccttttacaatctctaaaagctcatcaatctcggtatctctgtcttcctccacctgattatcaatgatttttaccacaccatcaattgtttctcttaagttatgtggagggatattggttgccataccaaccgcgataccctgtgccccgtttacaaggagatttggaaatctcgatgggagaatgcttggctctttctctgtctcatcaaagttcggtacaaaatcaaccgtatccttgtaaatgtctgctgtcatctccatggagatcttagataatcttgcctctgtataacgcatggcagctgcgccgtcaccgtccacagaaccaaagttaccatgaccgtctactaacggataacgggtagaccagtcctgcgccagattaactaacgctccataaatagagctgtcaccatgaggatgatatttacccattgtatcaccgacgatacgggcacactttctatgtggcttatccggaccgttgttcagctcgatcatagaataaagaattcttctctgaaccggcttcagaccatctcttacatctggaagcgctctggatacaattacactcatagcataatctatataagatttctccatggtatttttcaaatccacctcatggattttatcaaaaatattactatcgtccatactgtcctcctgaactatgatacatactcccgaaatctcaaatatttaagagattccgggagtatggaaatgtcaaaaaacttcttttatcagatatccagattctgtacatattttgcattcgcttcgataaactctctacgcggttctacacggtcacccataagagtatcaaatgtcatatcaagctctgaagctgcatcatcatccatatttacacgcagcaaaattctcttttccggatccatagttgtctcccacagctgggaagcatccatctcaccaagacctttatatcgctgaatcttattgttaccgtcacgtccgatatctgtaagtatcttatttaattcttcatcactgtaggcataccacaccttcttgttcttctcaactttatacagtggcggctgtgccagatatacatgaccttctttgataagatcaggcataaaacgatataagaatgttaataataatgtggcaatatgtgcaccatctacatcggcatcagtcataataataatcttattatatctgagttttgtaatatcaaaatcctcatgaattcccgtaccaaatgcagtaatcatcgcacgaatctcattatttacaagaatcttatccagtctcgacttctctacgttaagaatctttccacgaagtggaagaatcgcctgtgttgcacgacttcttgctgtctttgcagatccacccgcggaatctccctctacgatgtagatttcacaattctgtgggtctttatcagaacaatctgccagcttacctggaagactcattccgtcaagtgcagactttcttcttgttaaatcccttgcctttcttgcggcctctctggctctttgtgcaagcaccgccttctcacagattatctttgcaacatttggattctgctcaaggaaataagtgagctgttcgctaactacgctgtcaacagcacctcgcgcttcactgtttccaagcttctgctttgtctgtccttcaaactgtggttctggaatcttaatgctgacaatggcaactaaaccttctctgatatcatctccagtaagattctgctcactgtcttttaataacttattctttcttgcataatcattaaatgtctttgtaagtgcacttctaaaaccagctaaatgtgttcctccttccggtgtcgtaatattatttacaaagctataaacaccttcgttataagaatcattatgctgtaacgcaacttctacaactacatcgccttttttaccttcacagtaaataacctgtgggtaaagtacttccttactcttattcagatattctacatattcacgaattccaccttcatagtggaatgtgagagcaacattctcttctggtctcttatctttaaggacaatctttaatccctttgttaaaaatgccatctcacgaagacgctgttttaacactgaaaaatcaaaaacagtctcttcgaaaatggtaggatcaggaagaaatcttacttctgtacctctcttatctgtatcccctacaatctttaacggatacataacctttccacgttcatatctctgacggtaaatctttccctcatggaaaatatctacttcaagccatgtggacagtgcattaacaaccgatgcacctactccgtgtaatccaccggataccttgtatcctccaccaccgaactttcctcctgcatgaaggatggtaaacacgacttcgactgctggaattccctttttcttgttaattcctacaggtataccacggccattatctctgaccgtgatagaattatcttcattgatgtacacttttactgtatcacaaaatccagctaatgcctcatcaactgcattatctacaatctcatataccagatgatggaggcccttggatgaagtactgccaatgtacataccaggccttttccgtacagcttcaagaccttctaaaatctgtatctgatccgcaccatattcctgcgctgcagaaatctgttcttcactcataattcaacctcctgtcaaaacttaatcaaataattataccataaatatcgccatttattcaacttcttaaaccagaccatctgttttttcttcctgtacaatcccctcttttacacgaaataccttgtctaaggagatacggctgtttacaaaatcatcaagtcctgtgcaggaaattaatgtctgaatatcctgaatactttcaagcagccacgactgtctgcctgcatctaactctgataaaacatcatcaagaagaagtattggtttttctcccgtcacctgctcaataaggcggatttctgacagctttaatgacagcgcagccgtcctttgctgtccttgtgagccaaatttacgaatatcaattcccccgactttaaatcgaagatcatctctgtgtggcccgacacttgttgtccctgaagaaatatctttatttcttttagaataaagctgctctctaaatttttctgcctccacatttttttcgtattctactttaatctgctccttaccaccagtaagctgtccatgaatctttgccatcatctcatcaagaaaatatacaaactcttctctttttttaatgagaaactgtccggcagcaagaagctgttcatcccatccatccaaagtatcgatgagcgccggatataaattaatttgttttaaaagattatttcgttcattcaaaatcttactgtaagcaacaagctgctgcatatagcctttgtcaatctggctcagctccatatcaagaaatcttcttcttcccgccgggccttctttaataatcgacaaatcttccggagaaaaaaagacgatgtgcatcattccaagaagctctcctgagcgtcttaccggcacaccatttaccgcaactcctttgcttttatttttctttaaatgaacatccagacgatgggataatgaatcttttctgaaaaaaagccggatatgtgcctcatcttcaccaaaacgaatcaggtccttatccctgcttcctctatgagatcttaaagttccgcttacataaatagactctaaaagattcgtcttcccctgtgcattatctccaaaaaaaatatttactccaggagaaaactccacttttagcgaatcaaaatttctgtaattatttaattcgattgattcaacaaacatggagtcctcccttatggttattttacaactttaaattcttcgccttcgaattcaaaaacatcaccatcgtaaagcttcttacctcttctggtttccacttcaccattcactgttacctgtccgtcctgaataagcatttttgcatcaataccagaagatacgatgcctgctgccttcatagcctgtccaagcttaataaattcatctcttaattttaattcttccatagtttactttaattcctttctggcttttcaataatccggattatcaggataatctgtaactcttgataactatttgcatattatctctatttatcaccagctacacattactagtaatccgaattattaaataaaaaagttttcatgtccgtcaacagcggacaacttcgttaaaatttatacattgctgttacttacattgattggtaagatcaaatataagtaagaggatttctcatcacgaataatacaaggtgcgatagagttgataagataaatggtaacttcttcttcatcgataacacgaagcgcatctactaaaaacttagggttaaagccgataactaagtcttttccctctttgctgatcgcaatctggtctttcatggaaccaatctgagaagaaatcatcagattcatctgttcattttcaatcttaaggataattggcttcttgtcagactcttttacaaataaagtggagcggtcaagacagcgtaataattccattttgttgatagtcagcttggtttcataatcgttagaaagcatctgtccgatattataaaacttaccttctaataatctggaaactacttttgtctccccaaactcaaataaaatatgcttatctgttaaatataaattaatcgtatcttttgcttcacctggaagaatcttactaacttcggataaagttttacctggaacgatgacttccattttaggataagattcctgtaattcaatattacgaacggaaattctatgaccatcaagagaagttactgtcattttattattttcaatactcaaaagttctccggtcattaatttattattttcattatcggatacagaaaaaatcgtctgtctgattacttcttttaagtcaaactgagagagagtaattttgttttctttttcaatttcaggtaaatgtgaaaaatcgtctccctttcttcccataatgctgcactgaatctgttcacattcaatatttgtctttccggactcgtctgtttcgatacaaacatcattatctggaatttttttgatgatttcagaaaagattttagcttcaagtgcaatcttaccaggttcgatgattgttccctcaataactgtttctataccaagttccgtatcatttgcagttaatttaatgcaatcatcataagcttcaatcagtatacattgaagaatatccattgttgtcttattggatacagctttagagactgtatttactccatataaaaattgattcttagagcatgttatcttcataaatgtgtataactcctttcggtgtaaaatatatataaatataataagttattcgcagtagtagtagtagggggtgtgtaggatgtgaataactaagataaggccgataatacaaggattttcgaaaaggataactatgcggataagtatgtgaataaaaaaatagttatccacataggaaaaattgggcaaaagttatccacagctatccacaggcaattcacatcgaatctgaatagaatgtggaaaaaaataaagggttgtccccagtgtgtgaagacacctttatttttttgtttcttctatataaatgtactacgttggtgggttcaatttcttgatgatgatatcaaggttgcttttaaggttttcgtctgtttcaagcatttttccaattttgtcatgaccgtgtataacagtagtatggtcgcgattacccataatttttccgatattttggagagaatagtcggtatatttacgggaaagatacatacaaatctgtcgtggattagcgatttctttatttttcttcttagaaatgatgtcagaaacagaaatattatagtgttcggcaacgacatccataatcaactgtggagttacctctttttgacattcaatcgtatcttttaaagcattttccgctaattctaaggtaacaggcttcttttcgaggttggcgaaaacataaattttgtttaaagctccctctaattcacgaatattggaattaatatttgtagcaacgtattgcataacctcctgattaatatcaagatgctctaattcagcacgttttttcaaaattgccatcttagtttcgtagtctggcggctgaatatccgcagtaattccccattcaaagcgagatctaagacgttcttctaatgttgcaatttctcgcggatgtttatcggaagaaattacaatctgtttttttgcttcgtgaagttcattaaaagtatggaaaaattcttcctgagtactttcttttcctattataaactggatatcatcgattaagaggacatcaatattacggtatttgtcacgaaattccttattcttgtcatgttttaaggaatcgatcagttcatttgtaaatttttcagaggttacatataaaacacgtaaatctgggcgattattaatgatatggtgtgcaatggaatgcatcaaatgcgtctttccaagtccagctcctccatataaaaagagaggattgtatgcaccaccaggtgattcggcgactgcaacggaaacagcatgagccattttgtttgtcgggccgactacaaatgtatcaaatgtatatcttggatttaaattaccaatatattctgcaggaacactgacttttttcggttctgatttcggggctgcagaattggagtcggtaaaaagaattttaaattgctttccagtaacctgctcaattgccatagagaggtaaatgtcgtaatatttgtgttttataaattcaattcctcgtggtccacgtaccataaaaaaagtaatactgtcatctgtaattgtctgaataattagtggttgtatccaagtattaacggcaacttcggatatttcatgttcttttacgagaatattcagaatttcttgccattttgactcaattaattctttcattgttagctccattctggtttaatatgttgaactgttttagtaaaaatatcgagattaaaaaacagctcggcttttagtataagtgtataacagaaccgaagttttttcaatatacgaatcttgagaaaatgtggataacttattgtggataactgagaaaaatgctgttttttcagagaaaaaaatgaaaaataacacattgtggataacttaaacgaaattatacacatcaaaaattgcagattaacagtagctcttgacgaatttttgcggcggagttgtgaatatttcaatagttatgcacaagttatgcacattttgtggataactcgtgcataacttctgatttggatgtgcaaaaaattaaaattaaagatttaataagaaaaaacgcaggaattgcttgacttagagcacttttttcaatataataggagtgatgtttttcaacaagacaggtataatattcgtttaaggaggtggctttcgcatgaagatgacatttcagccaaagaaaagacagagatctaaagttcatggttttagaaaaagaatgagtactgctaacggcagaaaagtattagctagaagaagagcaaaaggaagaaataaattatcagcttaggtcgcagtgatgtgaccttttcttttctcattgattttttggaaagttgagaaagttaagtgagtgaatttaagtctttaagaaagaattgggagttccaggcggtatatcgtaatggtaagtctaaggcgaaccgctgttttgtaatgataataaagaagaatgacacttcttctaaccgcgtgggaatttccgtaagtaaaaaagtaggaaatagtattgtccgccacagagtaaccagagtaatcagagaggttatgcgtctccactggggagaaatcaagagtggctatgacattgtaattgtggcacgcccgtcagcgaaagattctgactatgggaaatttgaaagtgccatttttcatttgttgaatttacatcatttattgaaagacgacgatttggaatgaaaattattttgattaaaataataagattttatcagaaatatctgtcagctctcaaaggaagagcgacctgtatatatacaccgacctgctcgcagtatgcgatagaggcaattgagaagcatggtgtattaaagggggattgttagcagcgtggcggattctgcgttgtaatcctttttcgaaaggcggatatgatccggttccatagttaaggaggaaaagtatgttattgacgcagtctaccactccgattatcggatggattgctaccttacttgggtatgtcatggaattcattttctattgtctgaatttcatcggcattcagaacattggattatgtatcatcatatttaccattattgttcgattattaatgctgcctctgactattaagcaacagaagtttgctaagatcagtcaggtaatgcagcctgaaatcaataagattcagagaaagtaccgtaataagacagatcaggcttctatgatgaagcagaatgaagagattcagaaagtttacgaaaaatatggcacaaacccaacgggtggatgtcttcagttagtagttcagatgcctattttccttgcattatatcaggttatccgtaagattcctgcatatatcccgcaggttaaggctgtctacatgcaggttgtaactgcaatcgcaggacaggcaggcgcaattgatgcgattaataagattggtaagggattaaagtcttcttacgttacaagtcttgcatcagatgcaacaaagaatcagattattgatacactgaattactttaatgcagatgcatggcataaacttgccaaagcgattccatcagcatcagatgtaattaacacttcatctactcatattattggaatgaatgatttctttgcaggaatcaatgtatctcagacaccaggatttcatccttctatttattggctgattcctattctagctgcattattccagtatttatctgcaaagacaatgaaacagcctgagctggatggtaataatccagcagcaggaatgacaaagagcatgacagtcatgatgcctcttatgtctttatatttctgtttagttactccggcaggtcttggtatttactgggtaacaagtgcattattccagtgtttacagcaggttatcattaataaatatatggataacgcagatatcgatgctcttgttgcaaagaacaaagaaaaagctgcaaagaagaaagcaaaaggacagaaaacatttatggaaagactcatggatacctctgctaaggcagatgccgcaaaagaggagattgagaatccttccgcaagaaagacaattaagcaaattgcttccattaatacaaagaaaatcgctggaccagaaggaacaggtgcagaagattatgccaatcttgattctgttgatatcagcaagcttggagaaattggtaaaaaggcttatctggtatctcagtatgagaaggaacatggacataccaggggaggtaagaagtagtggaagttaaagaatttaaagcaaaaactgtagatgaggcaattaccgcagctactcttgagcttggaatcagcagtgataagttacagtatgaagtagttgatgagggaagcaaaggtttcctcggaatctttaatagcaaacctgcagtaattaaggtaatattaaagaagtctttattagaaagaacacaggaattctgcgacgaattatttgctgccatgaaagtggaaactacagtaaatattgattttagagaagaagataatgtaatgaatattgatttatctggttccgatatgggtatccttattggaaagagaggacagactcttgacgcattacagtatcttatcagcctttatgtgaatcgtgagagcgatgcatatatccgcgtaaaacttgacacagagaattaccgcgagagaagaaaggcaacacttgaaaaattagctaaaaaaatagcatatacggtaaagagaacgaaaaaacctgttgctttagagccaatgaatccgtatgaaagacgtgtgattcattctgcacttcagaatgacagatatgtctgtacgaagagtgaaggtgaggaaccgtatagaaaagttgttattatgttaaagagagacagataacataagtatgagattagggatgtttaaagattcttgcgggaatttttaaacattcctatttttatagcattttaacttgattttagagttaaaatttgaataaatggagagtgtgataggaatgataaatgaatttgatacaattgccgcgattgctaccgcagtatccaacgcaggaattggaattataagaatcagcggcagcgaagcaatggagattttggtgaagatttttgagccatataataaaaaagcggatgtttatcagctggaaaatcaccgtatttattatggtaatattaaagacggcgaggaagttgtggatgaatgtattgtccttattatgaaaggcccacacagttatacaaaagaagatgttgtggaaatcgactgccacggcggagtaacagttgtgtataaagtgctgaatctggtactgaaaaatggtgcaagagcggcagagccgggagaatttacaaaaagagcttttctgaatgggcgaattgacctgtctcaggcagaggctgttatggatttaattgattctaaaaatgagatggcaagaaaaaattctatgacgcagttaaagggaggattatccgacaaaataaaacagttaagagaagagattatttaccagattgcatttatagaatcggccttagatgatccggaacattacagcttagacggatttccagagaagcttttagaagaagataagaagtggattactatagcaaaagagatgctggattcttacgataatggaagaattatcgcagagggaatccgcacttgtattgtcggtaagccaaatgcaggaaagtcctcttttttaaatgctcttttaggagaagaaagagcgattgttacagacattgccgggacaacgagagatacgttagaggaatctgtgacaattgatggaattacacttaatattgtagatactgccggaatccgagatacagaagataaggtagaaagtatcggtgtagaaagagcgaagaaagagattgaaagcgcagatttgattttatttttaatggatacttcagtgcaaatcagtgaggaagatatcgagattcttcagagaatccgtgataaaaagaaaattattttattgaataagtctgataaagcaacagaagagagtggttttgaacagtctgctctaaaggaatatatttcagaggaaacacctgtaatttctatttctgcaaaatatggagatggaatagataatttcataatggaattaaaaaatatgatgtttcatggtagaatagacgtgaatcaagaagtctacattactaatgcaagacataaagatgcacttgccaagacttatgagagtcttgaatgtgtagagagaagtatagaggcaggaatgccggaggacttctttacgattgatctgatgaatgcttatgagaagttaggattgattattggagagtccgtagaagaagatttagtgaatgagatattttccaagttctgtacaggaaaataaagaaacaaggagaatagcatgaaaacagtagaagaatactatgacgtggttgtggtaggagcgggtcatgctggctgtgaagcggcgttagcggcagcgagacttggctgtgagacaatcatttttaccgttagtatgaacagcgtggcattgatgccatgtaatccgaatatcggaggaagttctaagggacatcttgtaaaagaaattgatgctctcggcggagagatgggaaaaaacattgataagacttatattcagtctaagatgctgaataaatcaaaggggccggcagtacattctttaagagcacaggctgataaagatgcgtattccatgacaatgcgttatacacttcagaataccgaccatctgactttgcgtcaggcagaggttacagaacttattgtggaagatggagttattaaaggtgtaaaaacattttctggagcaatttatcatgccaagacggttgtgctggcaacaggaacgtatttgaaggcaagatgcctgtatggagaggttgtgaattatacaggcccgaatggtttacaggcagcaaattatttaagccagtctttaaaggataatggcgtagagctgtatcgttttaagactggaactccagccagaattgataagcgttccgttaattttgatgtgatggaagagcagtttggtgatgagaaaatcgtgccattcagctttacgaataaagaagaagatattaagagagagcagatttcctgctggcttacttatacgaatgaggagacacataagattatccgtgataatttagatcgctctccgatttatgcgggtgtcattgaaggaacaggcccaagatattgtccgtctattgaggacaaggtcgttcgttttgctgatagaaaaagacatcagcttttcatcgagccagagggagaatttacaaacgaaatgtatgttggaggtatgagcagttcacttccagaggacgtacagtatgcaatgtaccgtactgtaaaaggtcttgaaaatgtaaagattatccgtaatgcctatgcgattgagtacgattgtatcaatccaaatcagttgaaattgtcactggaatttagaaatattcagggacttttcagcggtggacagtttaacggaagttcaggttatgaggaagcagcatgccagggacttattgccggaatcaatgccgcaagaaagtgtcttggaaaagatccagtaattttagaccgttcacaggcatatatcggcgtattaattgatgacctcgtaacaaaagagaaccacgagccataccgtatgatgacttcaagagcagagtatcgtctgttattaagacaggataatgccgatatgcgtcttacaccaatcggtcatgagattggcctgattgatgatgagcgttatgataagttccttttaaagaaagaacagattgagaaagaaatcgagcgtttaaaacatgtaaatatcggtgctaataaaacagttcaggagttgctggagagcctcggaagtacgaagctaaatagtggttctacattagaggagttaataaagcgtccggaacttaattatgaatgtttagctccaattgatccagacagagagccgttagacgatgatgtagctgagcagattaacattaacattaaatatgaaggctatattaagagacagcttcagcaggtagaacagtttaaaaagatggaaaataaattaattcctgacacgatcaactatgatgaagtgcataacctgcgtacagaagcagtacagaagttaaaggcagtacatccacattccgtaggacaagcatcaagaatttctggagtttctccatcagatatttcggtgctgatgatttatatggagcagatgagacataggaagtaaggagattatatggattttaaagaaaaattaaaagcgagagcggaaaaagagggaatcagccttactccaaaacagttaggtcagttcgaacttttttacaaaatgctcatcgaaacaaataagtccatgaatctgacggcaattacagacgaggatgaagttattgagaagcattttattgatagtctgagttgtcgcagagttgtggatatgagtcagataagaacatgtatcgatgtaggaacgggagcaggttttccgggaatcccactgaaaattgtctatccggaaattgactttgtactcgttgattcactgaataaaagagttaagtttttaaaagatgtaaaagaagcacttggattagaaggcttagaagcacttcatggaagagcagaagatttagcaagagataaatctttaagagcagcttttgatttatgtgtttcgagagcggttgcaaacttaagcgtgttaagtgagtactgcgttccttttgtcagaacaaatggatattttgtatcctataaaggaaaaaagggtttagaggaaatttctaatgcacaaaattgtatgaatgtgttaggatgtaagatagaaaaagtggatgatttccgcttagaagaggatgaggcagaacgtcttttgatcagaattaagaaatgtaagggaacaccaaagctttatccgagaaaagcaggaacaccatcaaaaaatcctttatagaaaatttatagaaggaaacttaaagcaagtttaaagaagcatttctatgtgctgttttattgaatttcagttgagtagttgagtaacctgaagttgaactcaattaatgcagaatgtctttttaaacgtgcttcagctgagataggattaaatatatcatatcagaaagatagggcagattagtatggatataaaagaaaagaatgatatttttatagataatgcaaatttacaggggagaatgtcagtttttcatgataaactaagaaagcatctttctaatgaatatttgtttttatcagagaaaaaggataatcttgaaaatgagattctccagttaaaattagaaaaagagcagaaagataagacgttatttccccacatcgaaaaaagggatgtcagaaaatatttttcaccattaaatataaatgaaatagacgaagaacaaaaagatgagaaggaaaaacagcttactgcgaatataagccgcatcagtgaggaagcagaattattagacagcaggatgcttgagattaaagatttcctgcaggatatagaatctatgcttcaggaagattccgaagacagtatgtctactcttctgatcaagggagaaaaaaacaggatttctgtagaagatttttataagaatcatgaagtatatccagaacttttactcaatttaaaagagctgactactttttttcagaatcaatatgaaggacttgaaattctcttagagtttgaggatgggggaattcagcttgatacaaaagtagtggcaaatatattaagacagttgacgattaatattatgtctgctgtggaagattataatatttctatgattttaatagagggtaaagtaactgatgataaaattttgctcactctgaattgtatgtgtgatgatggtccagtggatacgtttaaaatatcttatgatatagatagaatatagatggataaaaaagtttgaaaatgagatttctataaatcatataaaaacttgtgagtcagatttcttataaattatataagaagcttgcaaatgagatttttataaatcatatataaaaacttgtgaatcagattttcacaaatcgtataaaaagattctaaagatgaatgaaaaagagaaaggaagtaaagaatgaaaaataagattattgatattttatccgaaaatattgagcagttggataaagaagagattgcagcagctttagaaattcctaaaaaaacagatatgggagacttcgcttttccatgttttaaactggcaagggtattccgcaaagccccaaatatgattgctgaagaactgacagcacagattaatgaaaagggatacgatatttttgataaagttgtcaatgtaggagcatacattaactttttcttagcaaaggaagcatttgcaaaagaaattatgaatactgttgatactccagactttggccagggaacagagggagaaggaaagacagtttgtattgattattcttctccaaacgtagcaaagaacttccatgtaggacatttaagaacaactattatcggaaactctctttataaaatctattccaaattaggatatcatgtagaaagaattaatcatttaggagactggggaacacagttcggtaagcttattgttgcctataaaaagtggggaagcaaagaagcagtagaagagaatggaatcgacgaattgatgaaaatttatgtaaagttccatcaggaagcagaaaaagatgattccttaaatgatcaggcaagagaatggttcgttaaaatggagcagggagacgaggaagctctttctatctggcagtggttcaaagatatcagtttagtagaatataaacgaatttataaattacttggaatggatttcgatcatttcacaggtgaaagcttctaccgtgataagactcatgaagtagtagaaaaattacaggaaaaagacttacttgtagagagcgagggtgcacatatagtacctttagatgattatgatatggctccatgtcttattatgaagaaagatggaagtagtatttatgctacccgtgacttagctgcattattatatcgtaagagaacatataactttgataaatgtatctatgtaacaggattagagcagaaacttcattttgctcaggtattcaaagtaatcgaattattaggatatgactggtatcagaatcttgtacatgttccatacggattagttagtatggaaggtggaaaactctccacaagaaacggaaatgttatttatgcagagcagattttacatgaagccatcgaaaagattcatgaaattattaatgaaaagaatcctgacttaccaaacaaagaagaagtatccagacaggttggtatcggagccattcttttcaatgacttatataatcagagaattaaagatgttatctttaactgggataagattcttaactttgatggagagacaggtccatatgtacagtacacttacgcaagatgtgccagtgtattccgtaaggtaggagcggtagagttaccagcagaaatcgactattccgtattaacagatgacgcaacaatgaatctgttaaaagaccttacaagattcccagaagttattaaagaagcagcagacaaatacgaaccatttatgatcgcaagatttgcagtgtctgtagctcagcattttaataagttctatcatgactgccagattaacgtagaagaggaaaatgtaaaactggcaagattaaaagttgtagatgtaacaatgaaggtaattaaatccgcgttagacttattaggaattgaatgtccagaacaaatgtaaggtggattactatttaattcgttagacaaacagacgcctgagaagagaaccgataccctatatttgtgactttagtcgcggcggtttaaatgctcgctttatgcgctcgcatctaaaccttgctccgaggccacaaatatagggtatcggttctcttctcgggctgtctttggttggattttgtttgaattaaatagtaattgtggagatttgggggagagggcagaagttttctgcttactctaaaaatattgtgaatagatacttagtatttaaatggatttgttaaagaactgagattgagaatagaagcctgtttcttgttctgaaattattgaaatattgctgtgacaatcgttaaaaaagctaaatcataccctctattcccagccattctcgagtaagcagaagacatcagcttctgtcccccaatcctcccactttccatttaattcatcctctccagccacagtacagaagccagtgaagttcataagccatatttgtggtctcggagcaagtgttggatgcgagcgcgtggagcgaacattcaacgcgccgcgactaaaagcacaaatatggcttatgaacttcactggcttcgtctgtagtttgcttaatgaattaaatagtaaaaatgtttcacgtgaaacataatatctagcgtgatatcttatttcatgttataataattccgataagttgcaaaatttgaagtttgaaatttaaaatttgaatatgggagaatttgattttaaaatttgcaggtttatagggttttatatgataaaaatatggaggtttgtttatgagcagagtgattgctattgcaaatcagaaaggtggagttggaaaaacaacaacatccattaatctttctgcatgtcttgcggagaagggaaagaaagtcctcttaattgatatggactctcaggggaatactacaagcggttttggctttgaaaaaaatgagttagataaaacagtttacgaagttttaagagaagaagttagtattgaagaagcgattattcctgtagaggaatgttttgaaaatttatttttgattccggcgaatagaaatttggcaggggcggagattgaattagttaccagagagaatatgcagcatattttgaaaaagcagttagagccaattaaagatgaatatgattttattgttattgattgtcctccagctttaggaatgcttacagtaaatgcaatgacggcagcagattctgttttagttccaattcaatgtgaattctatgctttggatggtttatctcagctcatttatacaattgagttgattcaggagagcttgaatccagatttgtatatagagggtgttgtatttactatgtacgatgcgagaacaaatctgtctttacaggttgtggaaaatgtaaaggataatttaaaacagacaatttataaaacgattattccaagaaatgttagattggcagaagctcctagttatggtttaccaattaatctttatgataaaagatcttctggggcagaagcatatagaatgttagcggatgaagttattgagaatgcaaaataattagttacataaattgagtattatgcagtacaaagatatagtatataaacaggatttttaagggctggatattataatttgttaacatgattgatttgctgtttcatagatatgtttcacagtcagaaaagacaatatgtttcacgtgaaacattaggtggctatagtgaaacagtttatcgttatatggaaggagcaggagagttttatggcggttagaaaaggattgggaagaggattagatcttctgattccaaaagatgaaggtatgcctaagaagtctacagaaaaaaataaagagaataaggaaccaaaagaaaatcaggttcttacattaagtattcatgatgtggagccaaatagaaatcagccaagaaaacaatttgatgaagatgcgattgaagagttagctgattctataaaacaatacggagttattcagccgcttattgtacagaaaaaagataagtattatgaaatcattgctggtgaaagaagatggagagcatgtaagaaagccggattaaaagaggttcctgtaatcataaaaaattatgacgaaaaggaaacattaaagatttcgttaattgaaaatcttcaaagagaagatttgaatccaattgaggaagcaaaggcatatgaacagctttataatacatatggattaaaacaggatgaaattgctgccagtgtatcaaagagcagaacagctattaccaatattatgagactgctcaaactggatgaacgtgttcaaaatatggtaattgaaaatcttatcagcagcggacatggaagaactctgttatctattgatgatggagatatgcagtatcaattagcagaaaaaattcttgatgaaaacttaagtgttcgagaagcagaaaaactggtaaaatgtatattagaacacaaggataacaaaaagaatgtggaggaagaatcttctcaggaaaaaagcatgattgacttcttcgaaaataaaatgaaggatattttgggaagtaaggttgtcatcaaaaacaagaaaaataataaaggaaaaatagaaattgagtattattctaaagatgaattggagcgaattatagatttaatccaaagtattaaagaatgacactgttagcagaagatgatggagaaaaagtatgaatagtagaatattaaatttctttaatgtgaaactggatgcatttattgtttttgtatcagttgtagttgtaatcatgtttatagcactgttctttcttcttttagattacttaaaaatgagaaagcgatatgtggaatttatgactggagaaagcggaaagtctttggaatatacaatttataaaaggttcagggagattgacaagctgaaagctggccagaaagataatgatgctcagattgctattatttatgatatgctcagaagaaattacagcaaggtcggtatttataaatatgatgcatttaatgtagaaaattctcttagcggaggaagtatcagttttgctcttacacttttaaacagtagagataatggatttatcttaaatgtaatacataatagagcaggatgtcatgtttatttaaaagaaattaaagaagctgcatgtgaacaggtattagcagaagaagaaaagatttctcttgatatggcattaaaatatgacgaaaaaaaagaaacagataaataatatgataccagaatcaagatacctcttgattttaacatcataatatatgaacacaaaagaaaaagagttaagatatgttcaattcacatatcttaactcttttaacttgctttctgaattatataaatatataatgatgatacggaattataaatataaaaggagtgagagggagcggcatatatgcgtgaatatttaaaagcaattggttttagtgatttgaacagcagaaaaaagatagacgaactaattaatgaaataaagaaaaatcccagtagaaaaaactggtttcaaatagacgaagaagaagcaatatttatttacgaaaaagattttgcagaagcagtaggaattgcagtgatagaagttatggatagagatggatatcgagtaacggatcatttttacccatatgttcgcggtgcgaattacctgtatcatgaagatttagaatttgaacattatacagataaagaaggatatgcgggcatttgtgatgagaataatatcggtatcccactaatatttcatgtaaataatccagtagactatttaaaaatagtttatgggaagtttcatgataagataaatagtataactttgtccggaatgtcgaaaaagggaatgattatattaccagtcgaaaaagatgaatttcaggaacgggaagaacgaaagggaaatgaactccgtaatgaaatgatcgatgctgcaaaagcaggagatattgaggcaatggaacagctgacactagaagatatggatacatataccgcagtcagcagcagatcaaaaaaggaagatctatttaccattgtaacatcatattttatgcctcatagtgtagaatgtgataaatattctgttcttggaaaaatcatcaatgtgatggaaatgcagaacagcagaacgaaagagatattttattatttatcagtagagtgcaattccattcagattgaattcactatagcaaaagaagatttgatgggtgagcctaaagtaggacgcagatttaaagggattctttggctgcagggagaagtagactgcctgtaggcttgacaaaagaaaaaaaataatttaatatactttatgtatgttaatgtgtcgtcatagctcagctggatagagcactcgcctcctaagcgaggggtcggaggttcaaatcctcttggcgacgggcttcaaagcgttcgaaaatgttagctaaattagctgacaacgaacgcttttgttattttctaatcacgttcgtgacacaaaattccattcaaaatgattaatttccagccaacacaatccgatttttgttagctgacagctaatcaaaatcactggtttgcaaacatggtttttcaagagtccagctaacatttgggttccgctctgttgtcaccccttatttggggatgtaaatcagagaaaaggcgggaaaagaaaaaatctctcccaaacctgcaaacataaattagctgaaacagtattcaattctattagctacagctaatggtcaaacagcaatgtctgtttggaactttactatttataaaagttccaggcaggcattttttagtttctgaatcctggaggaaaggagtcaagatgactgagcaaaacagacaatcaggagaaaaagaagaaagaatcatagaaattgagattgagcgtcttcgcccttttaaggaacatccatttcaagtaaaagatgataaggaaatgtttcttctgcaggaaagcattgagaagtatggcatcttaaatccgctgatcgtcagaccggtaccggatggatactatgaaatcatatccggtcacagaagaaaacatgctgcggagaaactgggataccgtaaagtaccggtgattatccgagtattaagtgaagatgattccattttaagcatggtagattctaatcttcacagagaacggatcagctacagtgaaaaagcttttgcttacaaattaaagaatgacgtattaaaaagaaaaagtggtcgaaaaaagagccaagttgaccacaaaacaccaagaaagcgggcaatagaaatcatcagtgaagattgtggtgatagcccaaaacaagtgcagcgttatatttcactgacaaaactgataccggaaatgttgcagaaactggatgatgagattatttctttttgtccggctgtagagatagctgcattaagtgaaaaagaacaaagagaactgcttgtagcaatggagtatgcacaggcaatcccatcactctcacaggcccagaggatccggcaactgagtaaagaaaaacagttgtcactggaaaagatggaagagatcatgtgtgaagtgaaaaagggtgagatcacaagagtggcattcacaaacgagcagttgcacaagtattttccaaattcttatacaccggcaatgatgaaacgggaaatactggcactgttgaaattatggaaaaaagaatcatgggaaagttaaaggaggaagaaatcatgtgtaaagttatatccgtagtaaaccagaaaggtggcgtcggaaagaccaccacaaccgtaaatgtaggcattggactggcaagagaaggtaagaaagtgttgctgatcgacgcggatccacagggaagtttaaccgcaagtcttggatatgaggaaccggatgatcttcgcatcacattggcaacgatcaatgcactggtctcttccgattctgtgttgatacctgtgcaagccgcatatctgctggtgaaaggacttcagcagctgatcaagaccattcttacagtaaagaaaagactgaaccggaaactggcgattgagggcattctcctgaccatggtagatttcagaaccaattacgcaagggatattgcatcgagagtacatacaacctacggaagtcagatcgaggtatttgaaaatgtaatcccgatgtctgtaaaagctgctgagaccagtgcagagggaaaaagcatctacatgcactgcccgaaaggaaaagttgccgaagcatataagaacttaacacaggaggttttgaaaaatgaaaaatagaagtggcgaaaagattaaactggcaagcattgatgaactgctgggtgtggtaaatgaagaatctgcaatggagatagaaatcagtaagatccatccgtttaaaaatcatccgttcaaggtgctggatgatgaaaagatgcaggatctggttgaaagtgtaaggatcaatggagtactgacaccggtactgcttcgaatggatgataatgaagaatatgaaatggtatccggtcatagaagaatgcatgcagcacagcttgcaggacttacgactattccggcaatcgtaagagaattatcggatgatgatgccgtgattgcgatggtggacgctaacattcagcgagaggaactgttgcccagtgagaaagcctttgcttataagatgaaacttgatgcaatgaaaagacaggggagtcggacagatttaactttgtgccaaagtggcacgaagtcgagaacagatcagttattaggagaacaggttggagaaagtgcacgaagtgttcagcggtatatccgactgacagaattaattccggaacttcttgatctggtagataacaaaaagcttcaattcacggttgctgtcgatatctcctatatcgacaaggaagtacaggaatggatttacgaatatatcagcgacaccggatttatcaagccaaaacagattgcagcactcagaaatcagctgaatgatggaccaatcaatcagatccagatgttatcaattttcaataactgtgtgatggcaaagaaagtatcccggtctcttactttctcagaaaagaaactgacaaagtactttccggatgattatacagccaaagatatggagcaggtgattgaatcattattagaaaaatagatgcaggaacagtcctgttaaggatagaaaaagctaagaaaacaaagtcaaagaagtttaaaaagaggacttcttagcagaaaatgaaaggagaaaattatggagaaaaaaatgacatttaattatttttacggtactgaagctgatcagttcagcttctaccgcataccaaaagcattatttacagacagttactttaaagatttatcaagcgatgctaaaattttatatggactgatgttggatcgaatgtctctttccatcaagaatcagtggtttgacgacaaaaatagagcatatatctacttttccatcgaagatatcatggaattactgaactgtggcagaaataaagccaccaaatccatgagagaactggatgacgaaacagggattggcctgattgagaaacgcagacagggatttggaaaggtgaacgtcatctacgtgaaaacctttatgcctgagaaaacagatgagaaaaaatttgaagaggaattaaagaagtttaaaaaacaaacttctgtggaaaatgaggaacccgcagaagtttacaattcaaacttcatgaagtcccaaaatcaaacttctagaagtcccgaaaacaaacttcaagaagtttacatttcaaaccctaataatactaatcttagtgatactgaaatgaatgataataaatctaatcatatcatatctgtggatgagaaaagatttgatagcgataatcgctctgaggattatcaggcttatgaaaaccttgtcaaagagaccattgattatgaatcactggaagtaacccatcatgacgatatgcggcaggtagatgaaatcgtgaacctgatcgtagagactgtgatgtgtaaaaatgacaagatcttgattgccagcaactggtatccggcatcactggtgaagaaaaaatttctgatgctgacctattcacatatcgagtatgtcttacactgtatgagtggtaacaccacaaaggtgaagaacatcaagaaatatttattagcagctttgtttaatgcaccgtcaacgatgaacgggtattatcaggcagaggtgaaccatgatatgccaggactggtaagataggaggtgcacatgtttattttaaaacttgttgggaagatattattactgccggtatggctgatcctttttgtgatcggtttggcagtaaaaatgacagtacagacttatgcggttgtcagaggaatccttgggtttatattcactttattgatcatagcgactgcatactgttaccatgattgggtacaggttgcattcctgttttcgctgagtgttattctgtatctgatcctttttgcaggagtgttcgtagatactgtactggacatgacaagagaacgtattattgattttattatatcgtgagaagaatatgaaaatgagtgaaaacaatgattatattcagttaccaccactaaaaaaagacacaccatctgatgtggtagcatttatgtgggagtacatgaaagtaccggagaattcaagagaaaaagttaagaatctgcttaaagatgcaaatgaaaatggagtaaaattaagtcatcaggcaccaacactgtatgatgttgtcccaaaagaagaaattgctgaatttgaagagcttatgcgcaaaaccatagctgacattgtatcagaagccagtagcgttgcctgttgggtgtatgtgcagaaatatgtgaaacagaaaactcttgatgaaatgctgcaagaattgccaggagcaggccagtttatcattgtcatggatacctggttcgaaagactgatggcggatcaatagaagttgtgatagaatgaagaaaacgatttgatgtgcaaatcgggattgaccgaataagttaatcgtgccatatggcttgattataaatacaaagataaaaacgcaatgtacattaaaaatgtactagagctggtaggtagcccagccgtcctatgcaaatagggtaagtaacctgcccctccgggttgtccattctttgttcaattcattttaggagggattcttatggacaaagcaagtggaaaactgacggtatattttgaagaaccattttgggtaggcgtatttgaacgtattgaagatggtaaactatctgtggcgaaggtaacatttggtgcagaaccaaaggattacgaagtgcaggaatatattcaaaaatactattttagtttgaaattcagtccggctgttgaaactgttgtaaaggatataaaaagaaatccaaagcgtatgcaacgagaagcaaaaaagcagacgatggaaacaggcatcggcacaaaatcgcagcaggcattaaaattacaacaggaacagaacaatcaggtgcgtaaagagagaaaccgcaagaaaaaagaggcggaagaacagcgaatgtttgagttgaaacagcaaaagaaaagagaaaagcataaggggcattaaagtcccttgggcttttgcacaattcgatatttagcggaggaatcattatatgtggaatgacaactgatttataaataaaaataaatcggaggtttatatgaattattcaataagagaattaaaacgagatgaaaataagatattagatacttttttgtacgaggcgatttttattcctgaaggtgttcctgtaccgtccaaagatatcattaacaaaccagatttgcaggtatatgtaaaagactttggtgagaacaagggagacttatgtttggttgctcaagttgcggatgagattgttggtgctgtatgggttcggattatgaatgattacgggcatatagataatgaaacaccgtcttttgcaatttcacttcttaaagagtatagaaactatggtatcggaacagaattaatgaaacagatgctaatgaaattaaaactagaaggatataaacaagcatcattagctgttcagaagatgaattatgctgtccgtatgtataggaaggtaggatttgaaatcgttgatgaaaatgatgaagaatatattatgatttgtaaattataggaactttcaacttccagtttttgaaactgagaaatcggaatttgtggaggataactattgtggataaagcagttatttatatacatggaaaaggtggtaatgctgaagaagctattcattacaaaccgctctttagtaattgtgatgtgattggtctcgactatattgcacagtttccatgggaagcaaaagaagaatttccattactttttaattcaatttatagaaactacaaaactgttgaagtaattgccaatagcattggagcgtattttgctatcaatgccttatcaaatcagcaaatagagaaagcatattttatttcgcccgttgtagatatggaaaggcttattgctgatatgatgatttgggcaaatgttacagaggatgaactcaaagagagaaaagaaattcagacaacctttggagagactctttcatgggattatctttgctatgcaagagaaaatcctattatatgggaaatcccaacgcacattttgtatggtgaaaaagataatcttaccgcttatggaacgatatttgaatttgtacagaggactaattcaacactttctattatgaaaaatggagagcattggtttcatacggatgaacaaatgaaatttcttgatgaatggataataaaatcttccaaataaattcaagtttgtctggttgtcctttgagaggggagaaatcctcttctcaaagggctttttctatttatacggatattcgcaaactacaggacaatccgaagaattatccgtgattgcaatgatgagcagtttttgcacagtgatgaacctgatgtgttacttcctcattttagctgccactcgcttagacatacatttacaacaagaatgtgtgaagctggagtaaatataaaggtcattcaagacgcactcggacattcagatatttcaactgcactgaacatctatgctgatgttacaaaagaaatgaaagcggaagagttcaaaggattggatagctacttcaaagtataatattggacttcacatacagaaagagaacatacagagtgttgtgtgttctttttttcgttggataaaaagagaaatgcttgaatgggatatctttatgtatctttaaacgcccaaattagaaatattactcttcttcaacttcgaataataactatccgcagtataaagcgccgccaccggattatgccccaatacacggtctttcgtcactgctgtcgtagtcagtgcctcggaatatttgtaaaacagactgtcatgccccacacaaagtccgaccacaacattcaggtccgtcttcgccttgttcagaagctttgcctgcaggatcggattacacatattcacaccgacaccttcgcagcattccgggatgccgaccgatgtcttcttctgtgttccggctttacagccgacaccatacacctcaaagccatgtctgcgcaggatatctgccaggatacggctttctttcaacaatccgacacaggttgcgatcccgatctttttcgcattaatcttctttgcaaaatccatgatttcttcgacacgggtatgtttgcagtaattctcatactctacttcagctgcagcgattgttactttgcggttctcgtcttcattgtagcattccatagcttcatttagaacttcttcatccatgtgtgttgtcagacagaaatccggataggttttatccattttgttgcagttttttactgcgcagtcgatacaggacatgtcttcttttttcattttttcattctccttttgtataccttggtatctacagaggcctgccactggcagattctctagattaagctttactttgtaaaatatcctctatttacttcataataacaaatacttatactacagacaatggttttccgtttttattttcttattttttgtagttcttttctatgagaaacgttccccgattcagggttgatttgtcatgaattgtcgattctgatttttgaaaaattattgaaaattatctttttaaacttgaagatatataacagtctctctgatagaccatcatctttggatttatactatcatgtataggttatttcgtcaatcaaaacatttatccactttcctcatttcaatcccagctctttcaatacctcagccgaataccagctacatggaagccaataaaccatgcaacagcggttcttttattcgccagtatatgcaatttctatctcatagccgccgttctcatagtaggcgtgggaaaaatagtatcttattgttatttctgaaatataaaatttgaatcataaaacttctttccctctcaaatccatttttaccaaaccaactactaacaatccaataaaaattgccgtgtccacaaataacagtacaacaacactttttaccactccgaaagtaaaaagtatggagaagatttccactgacaacacaataaaacacatataatttgtcaaatactctgttataatttctccataataattgttcatctgcaatttagcatgggaatttgctcataaatattgtggtaaagtctggtatgtctgtggaatggttatgttgccgataacagtaatattcatgcttttagtgattggaaaaaatgaagattgtgttgggagtataggaggaattatctgtggtgttcaacttattcctttaattgggtctattctcccaacagaaatagcattaaaaaagaattttgataagaatggaacaagacgataaattcaagtttgcagagctgacaatctatcattttatcaaagtaagctaattacaatcaataacaccggtgcgggattttgatatccagtaccggtgttgttgattccacaggggcttggggtgtagccaccaaatatattattaatttatcctgccatccttaccagcatcaaagattttgatcttttcaatgagctgatttgctgatgtcacaatccggtttaagtacttttcggtacgataatcagccaaagcattttctccataaaacatttcatatgtcttctctacttctgattcaggaaccagataaatcatgacaagatcttccatctggtgatagagtgtaggatagtttaaacgaaaggtctctccacagttcgggcaggtataaaggaaaatagactgattaagtaccttctctttcatttcaggattcagtacagtattaatgctgtcccagacttcaaaatctccctcatgatggcaggaagggcaggttaccttttctatatgatgttttgacataaataatccccctttcagtgagataaatctatagttttcttattgtagaatacacttatcctttattattttgccaggaaattactctgaatctccatcggcatatgataagcctggcctcgttttgtcaggctgtataatttaaagctcatgagttccggagtcgcattcaatgaactgcagagtccgaaataatccaggtcttcgttctgaaccatctcttcaatgtcttcatcttcaatcagtagatcggcagcaaacagattggcctggtattctgtattatccgtcatattgtagagtgtatcatcttgcattggagccattttcagctgggaacgatgcaggatgatatgccctaattcatgggcggcaacaatcatcttttcttcttcagaaaggaaactgctgatcatgacataaatcgtcttacagctcataaaacagtatcctttcagtgtcttatatctggaagtttccccgacagcaatgttcatctgatccatgatctcaaaggaatccctggtgccatatttcttgattaatttctttgtttctgtataaatgtaagtgtttctcaaataaatcacctcaaaagtaaaaaataaaaagggcagaaatatccttgtaactataaggtaacagattaggtgtacaataatcccgccttctattatttttcctcttggtttttcagatattttttcggtgtaaatttctttgcacgtcttttggaatccagataaagactctggatttcatccataaaagctattttatcttcgtcagtcagtgatccaccggcaaacatagctgcagcctgttccaggatctgttgagcctgtttggcaccgcgattaccaaactgttcggatgcttctgtgataaaagcttcatcctcactcatgagataagaaacgtcacactgtaatgcatctgccagtttctgatacagaacattttgttttgggaaacgtccttccacttcccaggatcgaatggtcctatatgaaacgccaaccatgctggccagttcctgctgactcatctttttttcttttcttaatgatcttactttttcaccgaatgtcataaacatacctctttctaagccttgtcttataagtttcattagccgcctcaaggcaaaacgggaaatgtgtttcctaaaaatcaaaaattaatcttgacaaagggagatatctctcccataatgtgaatcacagataagggaaacatctttcctataagatatacaatatttcctcttttgtcaacgaatatgtgaaatgaatttcctatattttgaagaaaacaggaaggatacacagtcattgatagtcaaaatgggatacatgttacaaaaagaggaaagacatttgggaggtgacaatgtgagtcaggatcagacttctattatctgtattgatctgaagtccttttatgcttctgtggaatgcgtagaacgtgggctggatccatttaaagcaaacctggtggttgcagatccgaccagatcaaagtcaacaatctgtctggcaatcactccggctatgaaggctcttggcatcaagaatcggtgccggatccatgagataccggattgtgtgaagtacattacagccatgccgaggatgcagctgtacatggattattccgcaaagatttattcataaagcaacagaacgaattattgaagaacagaaagaacaatcgaaggattcatagaatgcgatttaagagaaaaaagcctcatgaccatgaggaaaaatgaaagcaaaatacgttagctaataaagtgtataggctcaaaagggaaagtgcccttttgggccttattttgtgctttgctataagtaataccacaattaaagggcaaaaactagcgtttaagcagggtgtaacggaagaactgaaagcaacggatatgatgagatggataggattgatgaataacattcgagcctgtgccgatgagattgtattgaatgatattgtgtattcctaacggataccaaccgaagaagaactgctgtcaaaccgatggcagtttttctttttcggcatgtattcaagaagtcattaagtcgtgagtataatcgaagtggtagaaaagttatctcttatatcggttgtaacttttttatgactctattgacaagaaaacttggtatgtgtataattaaaatatgcaaagaaaacttggcatggaggtgtttttatgaaaaaggacgaaatcttaaatgcaagcagaaaagaacatcgcaataaggacttggctgaaatggaagtggtatatcaagccggaagtcacgcaagcagagttggtgctttagtgtgttgtttgctttcgctgttatcttctgtgcttgctcatactatgatttacagtccgtgggttatatacttcagcattattgcaacacaatggttagttcgttttatcaaaatgaagcgaaagagcgatttggtcttgactgttctgttttttgtgttttccattttggcatttgttggatttgttagccatcttttagaggtgagaatatgaaagaacaattacaactgaaaaatcacttaaaggaagttcgcacagaagcaaatctttctcaagctcagcttgcagaaatggtaggagtatcaagaaataccattagttctattgaaacaggacagtttaatccaactgcaaaattggctctaattctttgtattgcattggacaaaaaatttgaggaactattttatttttaggaggtcattatggaaaatattataatgttgattttgggagtgttcatatctgttgtgggaattgtaaatatcaaaggcaatatcagcacaattcactcttataacaggcgaaaagtaaaggaagaagatataccaaagtatggaaaaacagtcggcacaggaacgctgattataggaatatctcttgtagtaggttttattgtttcgttttggagtgaaataattatagattatatcattcttccagcagttattgtcggattaggctttatattgtatggacagttcaaatacaataaaggaattttttaagaatcagggaggtataaagatggaattgaacacaatatcaggactggcgatagcgggagttatctgctccgttgtcctctcgatgggggtaccgattgctttgttcattgcaggaagggtgaagcttaaggcaaggatttcttcgttctttatcggagcaggaacctatctgctgtttgcagtttttctttttgtaaagtcaaggtttttaggcttgtcatctttccatcctgataaaaggatctcagccaatttctggcttcttcatatttctgaatttccttcgcatgttctttccggtactttcctttgtactttgcatttgaaaattgggaataaacttccttatttgcatagtactgtccggtataacggatctgatcgttgagaatccttagatcggatcgatgctgagcaaactgtgtctgcatttctttcagttcctgctttgatgcaagcagtgtatttttcaaatctgactgcgtatcaaatccatgttcctgcacatagataatggtatttgccatttgctgcaggttagaaagttttacccgatgagcataagctgggctctgcattgctttcacatttgtctggagatttacaaccagacgcaggtgagatctgacgtagagaatgaccaatggatctttgcgtaagaaggtctgttccaggtgctcttttccatatcgtgttcccagtgcacgttcagtaatccgcttctgtcgatcaggatgaagatagctgtatctgccacgatgctcaatcacagagatttgaaattgttccagaagtttggattggaattcatcaaaactattggatgtggcagcacattcatcaatcgcatttcgtaaatattctttctgtgtaaggaacacggtggatgttggtttgagaccatcttcaataattttctgattgatctcatccagtttttgctggccgtgtttctgtgacatatattctttctgagtaatttttctctcagccggagcaagaagatctatctggtgaagtccttcctgttggcaccgatccatgacagttttcttaaaagcgttcatgaatttatcagtggaacgatgcttgtaaccggcagcttcctcatgtggtttatccatataaggctgcctttccactgcagtcatcctcacactgtttatgacgatgtgggtatgaatatttccagattcattgtgtccatcggtatgagtaaccaccagagcctgatatccgggaaacatctgcttcgcaagttccaaactgattgcctgtgctctctctccggtaagtccgttttctgtaacatcagctggatcgtagctgataatgtagtggtgacttttgatatcttcacgtttcttatttttgtgaaaatgagcatttgtcagttcacattccttgtcaaaagacattggatcacagctcaacccatccatgtaaaactcttttcgcaggatgcttcgtccggattcatctacaatctttttcccggttttttcatcatcttcaaacagaaggtaattgatagcagccgagtaatttgcatttctgcttttaatgtgttttacgattgccattcataccacctgccagtttcagtacctcttttctcaataggaataagtccgtgatgcactgatggatttcattttctatagcacgagactgactgccaccactgttaaaatgcttggcaatctgattgaggttcgatccaatctttccatattcactgaccagtttcctgagatcattcatgtctgcaacaacttcaatttggtgattgatttgcttttcaagtagtagttttctcacatattcagaacgagaaagtcctgtaacgtcagcggcttcatttaatactgccaattcaatatccgttaattttaatgtgatgatgttactcctcttgagattcttttctttcttcttaggtgccatagtcctccttcttttttgataagacatcttggatgtgcgattacactttttaaccggctgtcccttccggttatataaagtgctgcgactatctttgatagagagccaacagatgtctttgatgtctgtacgagggtatggggaatcggaatccccatcaagagacttacccggaggtatgccgtagccataaaatggcgatacggtaatacctgggtggatcttgctctgtatgtgtacccctctatataacgaaacgctcagaggctgttttacagtgggggaaaagaaaaaatatcaaaaaaatgatgattaatggtgagcttgtgatagaatggaaaaaagagaaaagcataaaggatgtagttgtggagaatatttgttatgattagaaaattgctgaacggagatatcgatagagtcgctgacatatggttaaagacaaatctgaaagcacattattttatttccaatcaatactggaaaagtaattatgaattagtgaaagaaatgatgtcacaatccgaagtctatgtatttgaagcagataaaatgatacaaggatttgtaggactaaatgatgaatatatcgaaggtatttttgtctctgatggaatgcagtcatgtggcataggtaaacttttattggattatattaaggataaaaaagaaagattacaattaaatgtataccagaagaatgtcagagcaatttctttttaccaaagagaagggttcattattcaatgtgaaggtttggatgaagctactggtgaaaaagagtacactatgctatggaaacaaaaatagaaatcgggagttggagggaataaaaaatatggaattaagactattgcgctattttctgacggtggcaaaagaacagagctttacaaaagcagcagaacaattgcatattacccagccaacgctatccagacaaatggcggcatttgaagaggagcttggagtaacattatttattcgaagcgggaagaaaatttcgcttactgaagaggggattttattaaaaaggcgtgccctggagatccttaatcttgaggaaaaaacacttgaggaactgaaaggaaaagaagatgttgtagaggggaatataaccattggatgcggtgaatttgcagcggtggagacattggcggagatatgtaaaacatataaagaaaaatacccgctggttcagattgtattgcatactgcaacagcagatgcagtgtatgagatgatgaacaaaggacttgtagatattgcattattcatggagccggtggacaccgaagggctggattatatccggatcacagattgcgatcactggtgtgttggaatgcggccggatgatccgctggcagaaaaagagtttataagaaaagaagatcttattggaaaaccattgatcctgccggaaagagtaaatgttcaaagtgaacttgccaattggtttggaaaagacttttcgaaactgcagattgcttttacaagtaatcttggaacgaatgccggagttatggcagcaaatggactgggctatccggtatccatcgaaggtgctgcaaagtattggcgggaggatattcttgtacagcgaagaatttctcctgaaatcacaacaagtactgtgattgcctggagacgaaacattccatattctctggcggtcagtaaaatgatagaagaaataaatgcttttcaggcatagaatggaattcaatataagcattagacataataaaaatatcaggtataaaatagatgtataagagaaattcaaatcttatacatctatttttatacgaaaaattcgcaaagaaaggggatttttattatgagtaaaaatttagtcgcatttttcagtgcaagcgggacaacaaaaaaagtagcagaaatgattgcagaggaagcaaaagcggatttatttgagattgagccaaaagttccatatacaaagactgatcttgactggatgaataaaaaatcccgcagcagtgtggaaatgagtgataagaaatacagaccggagattatgaagaaaaagatggatatgagttcttatgacgagatccttctgggattcccaatctggtggtatgtagctccgacaattgtcaatacatttttggaagcctatgatttcagtggcaaaaagattgtgctctttgcaacatccggtggaagtggattcggtaatactgtaaaggaattacagccatctgcaccggatgcggttatcacagaaggcagcctgttaaaccgtggaacaaaacaggaaatcagtgagtgggtaaaatctttataaataacagtgctatggaggtatacagaaaatgggaaaaatagtacagacagcaggaagaaatacacttggtgaattcgcaccggaatttgcacattttaacgatgatgtacttttcggcgaaaactggaataaccaggacatcgacgtaaaaacaagaagtatcatcacagtggttgctctgatggcttccggaattacagattcttctttaaaatatcatcttcaaaatgcaaaaaatcatggtgtaacacaaaaagagattgccgcagtaatcacacatgtcgcattttatgcaggatggccaaaagcatgggctgttttcaatcttgcaaaggaagtgtgggaggcaggtgaaggagatttaccatacgaagaggaagcaatgcgggtgcatgcaaaagagatggtatttccaattggtgcaccaaatgatggctttgcacagtatttttctggcagaagttttcttgcaccgatttccacttctcaggttggcattttcaacgtgacatttgaacccggatgcaggaataattggcatattcatcatgcaaaaagcggtggcgggcagatcttagtatgtgtagccggccgagggttttatcaggaagaaggcagggatgcggtagaaatgaaaccgggtgactgtattaacattccggtagatgtaaagcactggcatggggccgctccggatgaatggttttcccatctggcaattgaggtgccgggagtggattgttccaatgagtggtgtgaggcggtatcggagaaagagtacgctggattaagataaggagagcactatggaatacggtaaactcggaaatacagatatagaagtgtcaaaattatgtgtgggctgcatgagttttgggaaagctggaaccatgcatgactggacgttggatgaagctgaaagtgagaatgttatcaagcatgcacttgatttgggatataacttttttgatacagcaaatggatattcagcaggaacaagtgaggaatatttaggtaaagcattgaagaaaaatgtagcgagaaatcaggttgtgattgcatccaaggtatattttaatgaaggtcgtttatcaaaacaggcaatcatgagggaaatagatggaactctgtcacgtcttggaaccgactatcttgatttatatatcatccatagatttgactatgatacaccaattgaagaaactatggaagcactgcacgatctggtaaaagcaggaaaggtcagggcacttggtgcatctgccatgtatggatatcagttttataatatgcagttagccgcaagagacaatggatggacaccattttctgcgatggagaatcattataatttgctttacagagaggatgagagagaattgctaccaatttgtaagcaaatgaaagtttcgttaatgccgtatagccctcttgcagccggacatctggcaagaccacagtggagatcagagtctcttcgtggaaccacggatagggttgccatgggaaaatatgataagactgaagcggaagacatgcagatagttaaacgtgtagcggagcttgccgaaaagtataactgcaaaatgtcccagatagccattgcatggcagtgggcaaagggaattctatcgcctattattggggcaaccaaaacgcagtatctggatgattcagtcggagcatttgacattaaattaactgccgaagactttgcatatcttgaagagccatatgttccacatgagatagttggtgcaattgataaaaatccggcgcaaggtgttattttgcttgatgaaaagaaataaagtttcagtaatcatagagtgtatgcgctcagtgtctgtgaagatgaacgattaaagcttgcaattaatctatctttctcatgttccctgcgacttggtgagctgcttggtcttacctgggattgtgtagatatttctcctgaggcaattgaagaaaaccgtgcatatgtcttcatcaacaaagaatcacagcgtataagaaaagaatctttaaatgcattggattcacaacagttaagtgcatctggtcgtaaaggcctagacccacaggcgcagcttttgctgccttaaggattttctcaaggtctgaagacaataatggttcgccgttataagtacgaacagagtgtctgctgataagtgtgtttaaaagttccattttaaagtctcctttattattaaaatagtattgacagtgattctttatcttatatattattgcggcaggaaaaacttatcaagtacgcagaaataactaacttggtaataaatttcttactggaggactgaaaatgaaagatgttaactatcaacttgatgaatgtccggtgcaaaagatattgaacttatttcagagaaaatggaatctgagaattatttacgaattatcaaaacatgaatccatgcggttcggagaattgaaaaaagctgttctggatatttccaatacagttttgacatctacattaaaggcattagaaaatcaaggtcttgttttaagacagcagtttaacgaggtgccgcctcatgttgaatattcactgacggaaagtgcaaaagcattagataaagtatttcagaccatgagagaatggggaaacagatatttataatttggaattggaggttatcaggaatgacagaaagagaaaaaatgataaatggaaagttgtataatccaatggataaggaattagaacaattacgtctgaacgcacgtaaattagcaaggaaatataatttgacagatgaagataatcaagaagaacaagcacaaatattgagaaaattattgccggcaacagaggaacttccgtatttgcaggcgcctgtttattttgattatggatgtaatacttacttcggaaaattcagctctgctaattttaattttacatgtttagatgtatgtgaaatacatataggagataatgtgatgattggtcctaatgttacattggcaactcctatgcatccattgttacctgaagaacgcaatgtccgaaagaaagaagatggaagtttttataatcttgaatatgcgaagccaatcactataaaagataattgctggctggcatctaatgtggttgtttgcggtggtgtcaccataggagaagggtgtgtaattggtgcaggaagcgttgtaacaagagatattccaccctatagtctggcagcgggaaatccatgccgggttattcgcaaaataactgagaaagatcatatgtcagatagaattgaaaaaaattgaacaattccagtttgtcaattacaggtgacattgaaagagccagcccattcaaggtgctggctgtttcaaaaattccacacttaattttttataaaatcggttcaataacagcacgaaaatagtaatctaattcttctggtgtatgtttttttttatctttcaaccaccataaaaccatttctacaaagcttcctgaaatatgattaacaagaaattcttggggtaagtcttgatttcgcttgcggttgtgatttataaattgtgtttgtaccaattcatttaagctatccttaaagtaacgaaggaaaatttcgctactttcacaagatagtaatcctaaaatattgttatcattttctttcaaatgctgtaaaagatggcaaaaaacagattgtggcatttcttcatttgagtaaagcccgtgtatatgagttttatccatagcactgtcgatgatatgtccgaacagttccttacagactgcatttaataattcgtctttcgtttcaaaatgggcataaaaggtacttctgccgatgtttgcggtatcaagtatttcttgtactgtgatatgattgtagcttttcttttcaagcaatgtgctgaatgcatgaaaaattgcttctcgtgtcttttgctgtcgtctatccattatcttcctccgtacaaatttgaagaaatgttcaataacgtacatttcttttgatttaattattgttcgcccaaatatgctaatgatataatcgaacaagatgttagataacatacaaattatatcgtagtattttggaggtgtcaagaaaatggaaactgaacagaaaagcaagaaagggatagcatttgcgatacttgcagcagcactgtatgccataaatgctcctttttcaaagatattgcttgaatttatgccgcctactttaatggctggttttctttatgttggtgcaggaataggaatgatatttattgctcttatgcggaaaataaagaaatatgaagcaaaagaattgaaattaacaaaatcagaattaccatacaccattgcaatgatagttttagatattgctgctcctatttgtttactgtttggtctaaactctacaactgccgcaaatgcgtcgttacttaataactttgaaattgtagcaacagcgataattgcccttatggtattcaaagaaaaaatcagcacaagattgtggtttgggatattttttgtaacgttatcctgtggaatactgtcttttgaagatatatcaagtctgcgtttctcatatggttctttatttgttttacttgccaccatttgttggggatttgagaataattacactcgaaaaatatcgtcaaaagatccattgcagattgttctgctaaaaggaatattttcgggtatcggttccctcattatcggcttgtttattggagaacggatagaggcactttggagtatcgttgctgttctttgtgtaggatttgtggcatacggattgagtatttacttttatgtatatgcacaaagattacttggtgcagcacgaacaagtgcatattatgccgttgctccatttatagcggcaattctttcgttgattatctttagagaaatacctgatgttacttactttgtcgcacttgtgttaatgattgtaggtgcctggctttcttcgtaagataagccgctaatcagaaaagttaaaaatgagtaaaggaaatgctaaacggcattactgttaaacatgggtgaatcttactcttatttgtatccctctatataacgaaacgctcagaggctgttttacagtggggtaaaagaaaaaatatcaaaaaattgatgattaatggtgaacttgtgatagaatggaaaaaagagaaaagcattcaatgtgaagattttgatgaagatactggtgaaaaagagtacactatgctatggaaacaaaaatagaaatcggaatttggaggatacacgcatgaaaattgtaatcattaatggaagcgccagaaaaggaaatacgctggcagcaatcaatgcattcataaaaggagcgtcagaaaagaataaaattgaaatcattgaacctgacaaactcaacattgcaccatgcaagggatgtggtgtctgtcaatgctctaagggatgcgtcgataaggatgatacaaatcctacaattgataaaattgctgccgcagatatgattctttttgctacaccagtttattggtggggaatgtcagcacaattgaaacttatcattgataagtgctactgccgtggattgcagttaaaaaataaaaaagttggcacgattgttgtaggcggttctcccgtagacagtatccagtatgagctgattgataagcagtttgactgtatggcaaaatatctttcatgggatatgcttttcaaaaaatcatattacgcaacagccagagatgaacttgaaaaaaacaaggattccatgaacgaacttgaggagatcggaaaaaatttataaagcacgttccaaattcaagtttgttgaattaagaaaatcgttgtttatcaagctttttaattttgaaaatttctttgaaaaactattgactcctacgtaacgtaatagtttagagtatgcttatcgagaggagaaaatgacaatgatgacggtgaatgaagtaagtaaattaacgggagtgagtatacgcactctgcagtattacgacaccattggactcttaaaacctatatcgtgaatttcgataccttcatagctatatagggggatgtttggttgctctcgtgattgttttcatatagtcacccactttcaaaaattgaagtttttcatttttcgaaaccgctttgttgtacttagaatactgtctgctaatagtatatgcaagatgtcgctttcaaaaacacaaatttttttatttcttgaaagtggaaattatgtaaagacaacctgattcttttcttaatttcaggataaatgcagaaatctaatgttacgagttgcattaaaaaaactcgtaagaaaaaaagtaaaaaaatttgcttttgaccactgtaaaacatgctctgagcgtttcgttatatgaagggataatttttctttcatatttcaaagaaaagaggataaagaaatgtcagagaaaagatgttatacagttcaagagttacaggagatcttaggagtcagcagacctactatttataacctttatgcacaagcgattccgtcactctcacaggctcaacggataaagcagctgagtaaagaaaaacagttatcgctggaaaagatggaaaaaatcatgtgtaaagttatatccgtagtaaaccagaaaggcggcgttggaaagaccacaacaaccgtaaatgtaggcattggactggcaagagaaggtaagaaagtgttgctgatcgacgcggattcacagggaagtttaacagcaagttcatttattgaagctttgggaaggtaggaaatggaaatgaaagaagaatgtattatatgtaaagcaccacttatatatctcgaaaaagatgaaatgatggagtgcgtgttatgccataaaaaggaattaagcaagactagatgtgagcagggccattatgtatgtaatgaatgccatacaaaaggaatggatgtaattatagacatatgtcttagtgaaacatctaagaatccgatagaaattataagaaaaatgatggaacagccattctgtcatatgcatggaccagagcatcatgttatggttggttcagcacttcttgctgcatataaaaatgcaggtggtgagattgatttgccggaagcactacttgaaatgatgaatagaggaaaaactgttccgggtggcgtatgtggattctggggtgcttgtggtgctggaattagtacaggaatgtttatatcaataatctcaggagcgactccacttaaaaatgaaccttggggtctggctaataaaatgacttccaaggcacttgacgcaatcggaagcattggtggaccaagatgttgtaaaagagattcttatatggccataatctcagcgattgactatgtggcagagaatttcaatatacaaatggaaaagcctgttataaagtgtattcattctgataagaacaaccaatgtattaaggagaggtgcccatttcatgaataagaaaaaagtcgcacttatctgtgttcataattcatgccgtagtcagatagcagaggcattgggaaaatatctggcatcagatatatttgaaagctattcggccggaacagagacaaagcctcagattaatcaggatacagttcgtatcatgaaagagacttatggaatagacatggaagcaaatagtcagcatagtaagctgattactgatatcccagatgttgatattgcaatatccatgggatgcaatgtgggatgtccttttattggaagggcatttgatgataactggggacttgatgatccaacggggaaatcagatgatgatttcaaggctgtgatacagcggattgaggagaatatcatggagctaaagaaaaggttgagtgaaagtggagttttgcgtgagtaaacattagaaaatacagatggttaaggtggtgatcaatgtggtcatcactttttctatttctgaaaaaaggtgatttacaagatgaagctactggtgaaaaagaatacaccatgctatggaaacgaaaatagaaatcggaatttgcacaattcttgaactcaacacaaactgccatcagtgttgttccgttgctcgttctttgctggtatcatagaaccatcaaatgaaggaggcaacaagccatgaatacagataaaatctatgcagaacaactcgcaaacaaatatgcacccaaggacaccaccaaggtggtcgctcttcgcaagctggatacaaaagccaagcttcccgcaaccgtttttacctacacattcggtattgtcactgcgatggtggctggtgttggggatggataaaagctatgataggatgttccgtcatgtgtttacgccgattccattacgtatgttacaggtgtgattcagcagtgtgtaaaaatgccacaaagcgaaacaacgaacgctgtttgacaacttagaatttgtgatattttaagaaggagccttcgcttatgcgaaagctccttttctgcataccttactttttcagctttaagccatctcggaatgcttcgcccacacgctcggtgactttataatagccgtgggtgtaggggtcaaatgcgatggcgttgaccttagacatatcaattttcccatcccccataacgctctcatcggcagtgacattgaccaccttgccgataacgccgcatccgtattcattgttctgatactcgatgaacctgcactccaggcagatcggaaactcgttgatgagagtggatctactgtttctgctttgctggcggtcagaccactgcgggcaaatttatcggtaactttattgccggactctacgccgaaatagtctgcttccactatgtgggctgcatcggcaatgctgacggtgaatgctccccgtgccttgatgttctgtacggtcttgtgtgtctcggtgaggttcacaacaacggtgtcccgctactgcatggtgccccatgcggcgttcatgacattgtcgctgatctccggcaagcacaagatggtcattctttactgcttgatatgtcccatgatatcagaactcctatgaatgcaatcattggttatgcagaactggcgtccggacatttgccccctatccgatatagcctccggcagggacaaagcctgctgttataggtttttgctattgttagagccgtttttctgatataataaatatcagaaaggcggtatttttttatgatgacaagaaatacagataaaaaacatatatagagggggtgagtgcttgaattatctggttattgatttagaaatgtgcaaagtcccaaagaattatcggggaaaaaattataagtatgcgagtgagattattcaggttggagcagttcttttagatgaagaatataaggaaataggaactttatgccagtatgtacatcctgagtttggtatccttgattactttataacgaatcttacaggaattgagaaagggcagataaagaatgcaccgaagctgaaagatgcacttattcatatggcagactggcttggagagcgggaatataaagtttttgcatggagtaaaagtgattactggcagcttgaccatgagattaaaagtaagaagttaaatgatgagaaactggatgaattgatgaagccagagcgttgggtagattatcaggaaatattcgggaaaaagtataactttgagcaggcagtaggtttgcaggaggccttgatgctatgtgatattgagccagatggaagaatgcatgatgggctggatgatgcatggaatacagcacgtcttattgaaaaattagaaaagaatccaaattataagctcatttatagggaacggcaggagcaagaagattcacagccattaaaggttcgattaggagaactatttgaagggttgaatttgcagcttggataatgaagatgagagatagcatggatggaaaataaagggtagattatggaaaatatagatttcatcacatattgatatccagaatcattagcattgaattgctctatttataaaaattaaattatggattattaaagaaaatatagcaatgcagaataacaggaaaagagattattatgaagaaaaaaatagcagtactgtttccaggtattggttatacttgtgataagccattactctactatacaggtaaacttgcggtagcaaggggatacaaacttgtgaaagtagaatatggtaattttccatcaggaataaaggaaaataaagaaaagatggaagaggcttttcgttgtggattagagcaggcagaaaaaattttgcaggatatttgctgggaagaatatgaagatatattatttgtatcaaagagtataggaacagtcatatcttctgcatttgccagaaggcatcaactctcagcgaagaatattttatttacaccacttcagcagacatttttatttgcagatgggaatgggattgtatttcatggaacggcagacccatgggctgatacaaaggatattacagaaggatgtaaaaagttaaatcttcctcttattttgacagatgaaggaaatcattctctggaaacaggggatacattaaaagacttagaaaatcttcaacagataatagggttactatttaattcattagacaaatagtggttgcggggacttgggggagagggcagaagacatcagcttctgtccccaaatcccctcccctctgtttaattcatcttctccagccacagcacagaagccagcgaacttcataagccatatttgtggtctcggagcaagtgttggatgcgagcgcgtggagcgaacattcaacacgccgcgactaaaagcacaaatatggcttatgaagttcactggcttcgtctgtagtttatctaatgaattaaacagtaataagaaaggcgtgattttatgggaaattatattactacatatacgagaaaacattttgatccgataaatcctgatgcagaattaatttgcattgaggatattgctcacgcacttccgatgatctgtcggggaaatggacatgtcagctcattctggtctgtgggagagcattgtattttatgtgcgaaggaagcagcggcaaagggatattctaatcgacttgtattggcagctttgctacatgatgcgagtgagtgttatatgtcagatgtaccaagacctttaaagcagaatatgaagaagtataaggaatatgagaatcatttattagatgttatttatacgaagtttttaggtttcacgttaaacatagatgaggagaagttgataaaagagattgataatgcattattgtggtatgatttaaagtatttattggatgaagaatcagaagaaaagcagccaaagctgcatgtgaaggttgattatacggtgagatcattttctgaggtggaaaaagagtatttgggattgttcgagaaatatagagaggtatagaatataagaaaaatactattaagaaatatattcaaaaataaatataaatgtaatcagatatatttgaagatagtgaaaaaactataataatattgtgaaggaatagagaggaaattgagatgaacgtacagatttttgggacgaaaaagagttttgacagcaaaaaggcagagcgctattttaaagaaagaggaataaaatatcagtttgtagatatgaaagaaaaaggacttagtaagggggagtttcattctgtatgtcaagctgtaggtggttatgaaaagctgattgaccctaagtgtaaggataaaaacttactggcattggttcaatatctttctgaggaagataaaaaagaaaaaattctggaaaatcaaaagattataagaataccgattgtcagaaatggaaagcaggcgacagtcggctatgagccggatgtttggaaagattggaaatagaaaagatagtaataagaaaatgaaaaaaggattgtcgtaagatagttctaagaaagggtgtgagctactcatgtgagttgtttcgcaccctttaaatattttatccttttctagagcgtgtttgaaaaaccattcctacaacctgcacgccccaatttgcggtatattttgccttcattcagttgacgtagcccgctacgccgccctcattcaggcgaaatctcccacaaattgtaacgcacatcttgcagaaagcatttttcaaacacgctctagcaagaagactccgacctctaaggtgggagatgagttgcgtctgctacctacttgatttagttcggtattataagtctgatactgtgaagaaaaatctgtaaatagaatttttctataataatgataagcggaaagttttaaaaagacatatattccaagtataaatcattaaatgctttatgatttgcaaggctgatttcttctgaaatttctggaatatgtgtaaagcgatgggataattcagagttcatcgctaacatgcctgcgcctgcgagagagctgtttccgacggatatgattcggtcgttcagttctttgggcagcataccgattccgacagctttggtataattgattttttgcccaaaacctccggcgaggtatagatgtgcaatctgagagtaatcaataccataggaggttacgaggatttctataccggcccgaatagccgactttgctaattgaacctcacgaatatccttgttagtaaatgaaatattctctgtcaatggatatccattatcgaaatatttatcagcaatcaatcctgtgttatcaacaattttttcttttacaagttcatagactgtttcaatgactcctgttccacagatgccaattggttttttatttgaaatagtagaaatggctggatgattatcgaaaatagttacggtatcaattgcgcctggaacaccggcaataccgtagcggatattgccgccttcaaaagccggacctgctgcggttgaagttacgaggagtcgatctttattaccgataaccatttccccgtttgtaccaaggtctacgagaagtgaaacttcttctttttgatcaattccgcaggctacaataccactgacaatatcggcacctacataagtactgatccccggaagaatcgtcatgtttttgtaggaatgcatggaaatatcaacaggggtgaaaggaaaggatccaagactttcacaggataatttctgaagtaaatgttgcatagtagagttgccggaaatgatgacaggaatagaaagttttgtgatatcttttcctagctgaaattgttcgcagatagaatctaaatcgtttaatatagttctctgaagctccaaaagtcttccctgattggctatatcaattcgtgaaaggacatcggtaccaaatattcgctgatgattgatactggttatggtctgtaatacttttttttgatttgtatcaatgagattggaagcaatggttgtagttccgatatcgacagcgagagcaagagaatcataactggaaatttcgttatgagtggatgaagatggagcagtagcaattttcgaatcagatttttctgaagatggctgcattgagatgtgttgaacggaggcagatttagatgaagagtcagagacagtatccgccgcagtaaacttatttgaaacagatttatctgccgacagattaaatgcagaggcagcctgaatctggtcttcttcataatcttctatctgaatagtaaactgcccttttacataagactgacatgccagccgccagccttcagagagttcttttgctgaaaaaaaggcagcgtcatgtgtagtatgggctggtatattatttaaaaattgtaccttacattttccacaggttcctctaccggcacaataggcaggtaaaaattctccattttcctgaaggtgtgtaagtaaagatttatttttatcggaaattgataattcaattgttttcaatggtgttcctcctcaattattaataaccatattataatataataatagttccagtgtaaatccttcaactcgtaaacgccataagcatctgaagccactcacagataagatatcagggcagttctttttgcgtctgttatcgcaaatgaaaattacttttcaatagcaaacggtttgctataccatattttgtgatatttggcggtatccttatttagaatatcattaagcaatttgcagatataagatatctggtcacttgtgccattatctacagttccataaatttctccagcttgtattttctgattcatctctggactgttattaattccgagaataagggggagtttgagattatgctgtttatagtaatcgtaaactccaagtgccatgtcatcattattgcagataatggcttctgcagattggataatgctagtatccagttttgaaaatttcacggaggcaaggtttctctgccaatctgcggagagattagtaagctgatttagagggaggttctggctgttttctaaaaagccatttgtccttcttacagcatcaaaatgtgtctgttctccttcgattagaatatagtccagtttattatttttgtttcggtccaggtttattttgtctgtattccatacattctggagcatgtctgcctgaatggctcctgctttttttgccgctgttccgacgtaccatgtctgtttggagatggataagtcctttttatccgcttctctgttaaataaaataacagggatatcgtggtttgctgtctcgtttaggacgctggcggcagaagatggagttacaaggttaataagcagggcatcgaagttttgggtgtacatatattggagctggtgttcctgccggttggcatttccttctgcatcaaagatttcgtaaagaacttttttgccagaaaaagaagaacggtcaattttgttttggagtttggttacatagtcgtttatgaaagtgtcgtccatatcataaacagcgatgcctatgtgggtgtatccattctgcgtttgaggtaatttccatatggttatggtgcttatcaggatgatgattaaggtaaacaggatggaattatagctaaaaagatttgttttcataacggaaatcctttcgtgttctgtataatttattatctgtagttgataaatattgactaaatttttggaaaactattatgtttagagagtgtttgaaaaatcattcctgcaacctgcacgctctaatttatggtatattttgtattcattcaggcgaaatataccgtaaattggggtgtgtagattgaattaaaactactcttctaatttgtcagtagtgcatctaattccccgctctcaatagctgccttatctactttatgacatggaatagatatatctttcatatatttatttcgtgagtaagtatccagcatttgaatgctttcatagccaagtttgtatgtgttttttatgtaaatgcagtttgttttgccgtcttggattttctttattacctgtgcagaaacaggaagaagatagcttggagaagggctgttttcaaaggctgcatagtgagaaaaggcagtttgcatcgtggcggtaattgccagtacattattgtaatcgtagtgtttttcttgttgggttaaatagttttctggataaattaacaggatgccaattgcatgattttgttcttcattagcgatgatggaagatagctcatttgaagaaaggcttttttcatgccacacgtcaagtataatagaattattgtgagagtaatctcggatggcatctaatatacgggaattctctttattataagtgtagggaaggattactgctaccgtttttttactttcggtgtttgtgcgtgtcatcatacattgcgaggaaaaaaaggcaatgaagagtattaagatgattactaaagcatattttttcttattatttttcatcagtttcctcctgattttaataacttcttttaatttagtgttattggctactgtctatttgggcagttttttgtaatatatattatagatttagttcagtgtagtattgttagattattacaagttgctgattttctataattttgttttattggattcatctgaatttatctctgcagtctcctccagtttcggaataattatcgttgcggttgttccttcatctaattcactttcaatagtgacaccatactgttcaccgtaaataagtttgattcgctcatcgacattacgcacaccgattccagagcctcgtttgctggaaacaacccggttgtgcatgatgtattccacaactttttctggcataccaagtccgttatcgcttacgtcaatgtgaataaggttatctttttcataaacagaaatagtgatttcgccatcatcgtacacaccttccataccgtgataaatagcattttcaagtagaggctggatagaaagtttggggcagagataatgaagaagttttttgtctgcctgtacggaaaattcaaacttgtccttaaaacggatattttgaatagcgaggtaacttgttgcgtgttccaactctttttccagtgggataatgtcttttccctggcttaaagaaatgcggaaaaacttcgcgagggaggataccatttgctcggcacctttatattcgccactctgtatcatccagatgatagagtccagcgtattatagagaaaatgcgggttaatctgagactgcaaaagttttttctccatttttcgtttttcccgttcatttctacggatttcgcccatttggttttgtaatttttctgccataatattaaaatgtgcacttaatgttttcagttcaccaattccattttctgcggcttttacttcataattgccctttccgaattcctgcatggtatcgagtaattggtagacaggatttgtgaagtcatggaacagcaaaatgtcagtgaaaacaagaataattccaacgataagcagaagcagccagattacataataaatacccatattttctgtgtgaatattaaacagggaactgacaaggacgatattccagccggtataaccaatctgctgacgttcgatcagccactttgtaccatgtagctttttgatgctgtaattggtgctgtttagagcaattttagtagtgttttctttatataaaccagaagaaatttcttttataaacggatgataaagaaagttcgatgtattatcaagcaggtagcagtaagagttttgcgtattcttataatgctctaaaattgcatcgatggaatcggtatagtactgcattaaaagaacaccggatttcattttgccgtgattaatgtactctacatagcggcttatctgaaatacctgttttacgttgtcgggataaacaagtttttttgagccgtaacaaatagtttcgatattatcttttgcctgagtaaaccagctttcattttgcatggaagtactggttaaattgttagagtgccataagtttttgccatctgtatcatataaagcgagtccatagattgtttctgaattgctggtgatttcatttgccaaaatagttttaaagttcttgtcctgaatatcatattttttgattgtgttgtagtaaatgttattcataatagaattgattgaatctatttcattttcaatattttgtgcaagtacatttttctgcctgctggtttcttctatcgttttacggacaagataggtagaaatataatgagaaaacagtatcatgcagcttaaaatacagaagacaatcgagatggacattattaaaggaaaaagaacacgaatgcttaattttttattgttcataaataaatcctttcgtttgtcagggaaggaaatttcccgtaaattgtgacgtacatcttgcaaaaagcattttttaaacatactctggatgccgggagaaggtccttttagttattttcccctccaagttttcggtattttaccggagagataccacagtgctttttaaatacatagctaaagtaatttggttcggggtatccgaccattgttccgatgacatggcttttgtagtcggtcattttcagtaacattttcgcttcttccatgcggcggctgatgaggtaatttaaaaaagtagtttccgtttcctgcttaaaaatctttgaaaagtaggaagaactcacatgaagttccttgcaaatggactctacggaaaggtcaggttcacggaaatgttcctccactaatttctttgcattttctgctaaaataacgttattatctacctgctttttctgaatcaatgtacgcatgagctgaaaataattaataagccagttgtcgagctcttcgccagtgtttaaagagagaatttttaccgccatttttttggaaccggcaaattctttatcagaggtaatctgatattttttataaaggcgggcgagggagaaggaaatctctaatatgacgatctggtattcatttaagttgtaatgggcttcatgtagatgttcaagcatatttaaaacagcagttttcagttcttcttcagaacagtgagttatgatcttctcaatggaatctacttcggaattccagtcatcgtctttttgaagcggtgcatccttttggagcggaaggatgtcattatagtaagtatagctctcatcttgaatgactacattataatcaagtgcttctagagcctgctgatagaggacaggaagtgcccttaaactggtaccgctggaactgatgccgcaggatattttcgtgtgaaaaatacgttcgataatgacggaggcctcctgtatagtacgggtaatccgttcaatatcgtgctttttattgccacatagcaaaaatacttctctgtcaatcataccgaaatggtagaggtccgttattttttcgagagattctttaatcgtttccttgatggaaagttcggaaagaacatcatttaaatcattttcacgaatctttacagtaatgatgtgaaaaacttcataatcaagattcagttttaaatttttcatttgaagagtacaataatcttcggtaagagtttctgttaaaagctgtgtaaaaaactgctgccgaagaagaggaatactttctgtataaatgttctccaagcgggtgcggttcattttctcggcatattctttttcgagttcctcatgcattgtagtgagaagtttctgcatttcgttgtagtcgattggtttcatgatgtattgtgaaactccatagctgatagcggttctggcatattcaaaatcatcccaaccggaaaaaagaataattttcgtgtttatgtagttctcatgaatggttttagaaagctctaaaccgtccataaatggcattttaatatcactgattaaaaggtctgggtgatattcttcaatgagttctaaggcctctttcccgttttgtgccgtaccaacaacggagaaaccaaggctctcccagtcgatgccgtttttcattccatataatatttgctgttcatcatcagctaaaataatagtaaagtttatcaagattttttcctcattttttctgtagtttatttgtggttatttatatggtatttgattttaagtttgtttttttatagttacgttgttgtgtgttttgaaatttattttttatagttgtttttctatttattgtgttatttatttttgacatagttcttttggtatggattttgctacttattttattattttgcagccgtttagattgtaccataaataagagcaagtcgattacattttatatcaatcaacttgcccttacttatttgccctataatgttttataactgttccgaaacatagaatttatttgaaatgtaagtttgtaaatttaatgaatcggaatagttagtgttatatactttgcacagtatcctgttgttatattgcagaaagcctttttcaaacacgctctagagcgtgtttgaaaaatatttaaagttatttatattgccaaaatcaattattatatactgcatatatgtctttaaaatatgtcaattatgatataaataatatttatttttgatattttcagtatcaacaagcagtaataactcttgtgttttgtataacttttatttttcaaacacgctctagtcttataccttgtgtaatattctgcgattattcttcagctttaccactaatcttagcaactacttttttcataaactcatcattaagcttatatttagtcttaaatacaacgtaagcaagaatgatgccgagagctggtacaatgcacatcagcacacggatggagttctgtgttgctaaagactgtactgcatttggaacgtatccagttaattctaatacgaatccgattgctaaagctgtaaaagctgcggtcagttttacgattaatgtctgaagggagaatacgacaccttcatttctgacacctaatacatattcgccataatcaacaacgtctgcaaggaaaacggtagcacatccaagttcaagacctgtaccagttttaacgataattcccgcaattgcagttaaaggaatattagaaggacatacaaatcctacaatgagcagtaagataaggccgattggtggaagcgtacaagccattaagaatgccttttttctggataataattttgtgactttagggaagattaataatccaactacctctgcaacagatgcactgatcatgaaagcagataacattccggcattattgcaaacatagctgaaataatatgtagcaacacccatgatagcctgaattccaatattgtataataaaattaagaggacagcccatcttaactggtcattctttttgattacagtgaaaatatctctgaatttcattttctctgcagttccggtagcctgctgtttctttggcaggttgataacgcagacagccattgtaaaaataaaggttgctgcgataattaatgcaaatctgtggtaaccagtatagttgccgccaagtcctttgataatctgaacaccgaagccggcgatgataagagactgaccgatgctggcaaaaattcttggtaaaacagatactttttcacgttcttccgggtcggaagttaagttaggaataatagaccaatacggaatatccataatcgtataagtcattccccataaaacataaacgacagatgcaaatacacaaagacttacacctgataaatgaaagtctgtaaatacggtaatgaatacaaaagcgttaatcaatgtaccgataacaagccacggaacgaatttaccccaccggcttctcgtattatcaacaatcatacccataaataaatcgttaaaagcatcccacaactttgcaacgaagaacatacttccgataaatgcgggagcaactttaataatatctgtaaaataaatcatagaaaaagttgcaatcattccatagattaagtcttttcctaatgcaccaaaggcaaagcagtacttcacacgatttggtatttttccctggtatataacaccactgttactgttgttttccatttttcctctcctctttttttatttgcgtgtttcttaacttgattggagtttagcattttagaaaaaagaatgacatttgatattctatttaaaaaatatgaatttctattttggaagattggattagaagtgggattatggtagactaattgagaatcacaggaaatattctgagaaagaaaatgaaagaaaataggagaatataagagaaaaataaaaaaaggggcaaataaaaaatgaaagaagatatatatgaaaataaatgggataaactactgaaaatccatacaatgggacgcgatgattccaatgcaggacaatattattatccctatgaaccaacgccatattctgtattagaaaggctggcaaacacaggaatcataagaaaaggcaatacacttcttgattacgggtgtggaaaaggccgtgtagactttttccttgcctatcagaccagatgcaggtccatcggcgtggaatatgatgagagaatctacaataaagcaatagaaaacaaagaaaaagccatttcagcaggaagagtagcatttaaagcggaaaatgccgaatacttttctgtaccaagagaagtagatagaatttacttctttaacccattttcacttgaaattttgcaaaaagtgatacacaggatactagaatcctattacgaaaaaccaagagagataaaactactgttttattatccgtcagatgaatatatttcttatttaatgaccgtagatgaatttatgtttgaagacgaaatagattgcagagatttatttccgggaaatgatatgagagagcggattgtgatatttggattataaatacttcaatgagaaaatgatattacttatctattatattcggtaatgaaattgcggcgtttttaatatcattttcatataatattattgcaatgagtaaaataattgctggaatatatcttttatacgattttataacattaatcttatatacattgattttatttttgtaatcttctctgctatctctctggatattacaaaattcaaaattaccacaaattttaataatacgaggcaggataaaatggaaaataaacatattcaaaataatagaaatgaaaataataagaaaaatgacacaacaaaaaagatagggaaaatacatattcaagaaaatgaatatataaaaaatcgaaataatttttacaatcaggaagatattcaaggaaatgtacactatgacagtacacataaagaaggacattctcataagcatgaggaattgtcagaacatcaacatattggtaaatcagaaaagtcatcagtgaatcagcacactcataaatcaggagagttgtcagtgaatcagcatactcataaatcaggagaggcatcagtgtgccagcatacccatacccatgtagatgcaaacggaaatgtttacactcatacacacacccattcgccccaaatcgtgaaaaacgaactaaaccgaattgcccggattataggtcatatgaagtctataaaaattatgattgaatctggaagagactgcagcgaagtgttaatccagctcgccgctgtagatgccgcagtcaagagccttagccgggttatattgaaagaacatatgtcaacttgtattgttgatgcgataaaaacgggggatgatgaggcgattgaagcattgaatgaggcgatagacaagtttatgaagtaaattctggagttcgtctgcctcgccagctcggtaattcaaaattcaccattgacatttggaaagaaaaggattattatatgcaaacaagttcgttagtgaactaattgccgaaaggcaacctaaggaatatgaaaaagatacataacaggaggataaaactatgcgggattcgttaattaatacctgtggaatgaagatgcgtaagcttcttgataaaaagtcagaggtgtttgcacagaaatacggagtgagaaatgtagaactggagattcttttatttttatatcattcaccatgtggtgatacagcaaaagatattgtggaggagaagaatttatccaaagcacacatttcaaagtctgtagataatttacgggcgaaaggttttgtcgttttgacagaggatgagaatgaccgcagaaagagacacattgagttgactgagaaggctgtggaagcagcgaaaaatatgctggaggttcataatgaatgtaaagaggttgtcatgcgttatgtgacggatgaggagaaagaacttatgaaccagataatgcagaagatgcttcgcagtctggatgaggaacttcaaaagtaacagaattactttacggaaatatttacagatagcatttacaggaagtatttttaatggcatcgactgataatgccactggaaaatgaccgggagaaattttagataatttttggagtattgatgaagatgatgaccaaagagttagtcagattagaagaaaggaatgcagtatatgaagtcagtggcaatagaaagggaatttggcagcggaggacgggatatcggaattcgcatcgcgaaagaggcacagattccttactatgatggacagttgctgattgaggccgcgaaaggatatggcatagagattgcaactcttaaggagtttgacgagaataaagtaggaagttttctctataatattgcgatgatggcaggctataatcagtatgaaaatatggcgaaaattaatgagattttttatggaatgaaagagacaatcaagaatcttcatgcagaaggtccggcggtttttatcggaagatgttctacagaaattttgaaatcctgcgaagatgttgtgacagtttttgttcgctgtagtgataaggagaagagggtacagcgcatttttgataaggaaaatgtagacacgatgcagaaggcacgtcgtttaatggacagaaaggattggggcagggaaaagtattttaagttctggacgaaaaaggactggaaggacgagaagaactatgatctggttcttgatacagcgaagttttctttggaggagtgctcagagattttattgaagaggatgaacgagtaggcattggaaagtataataataaacgatgctgatttttgatgaacatagtagtcagagtaaaattgttttgacaaaaagtagttggaggacataaagaatgacaaaaatatttaaaaatatggccccatactggtatatgatcgttgcgattgtgctgttgcttattgtgcaggcgtttggcgatttgtcgctgccgcagtatacgtcagatatcattgatgtgggaattcagaataaaggtgtggagcatattcttcctgtgaaaatgacggaggatgagtatgagatttcgcagttgtatatgacttcgaaagagaagaaaatatggaaagatacttatgagaaaaaaggtgagtattacatttgcaaggcggaggatgaggagaagctggatcagttagatgatacatttcttacagcgattttcttaaatcataacatgtcaaatgtaaaagaatcgcagtttaagaagatgattaagaattcgattgcttcgaatcctgcgatggctccgatgaaggataaaatagatgatatgagtgtcgatgagattggaaagatgctcaacatgaagtttaaaagctttcaggaggaagatgataacgggaaaaaggttatttacgttgatgtgcgcccaatgctgtatcagatgaagcagacaggaatgatgagtgccaaagatatccagaagtccagagaagaaatcgaaaagaaaatgaatgatattggagagagtactttattttctacaggtgttgcctatgcgacaaaatgtgataaagctgcaggagtagatatcgataagatacagacagattatctctggaaagaaggcggccgtatgcttggaattgcatttatgattctggtagcggcgattggagtcggttttcttgcttctaaggtaggtgcgagtattggcagggatttgcgaggaaaaatctataaaaaggttatgggattttcaaatgcggaaatgaaccgtttttctacagcatctcttattacaagaagtacaaacgatattcagcagattcagatggttacagcagttatgctgagacttcttttgtatgcaccgattatcggaattggtggaattattaaagtgtatcagaccggagcaggaatggaatggattattgctcttgcggttgttgtgattctcggatttgttatgctgcttgtttcgatagcgatgccgaagttcaaaattatgcagacattagtagatggtcttaaccttgtttccagagagattttaacaggactttctgttattcgtgcatttggcagagagaaaacagaggaagagcgttttgatgaagcgaataaaaagttgacaggtacgcagctttttacaaaccgtattatgacgtttatgatgccgggaatgatgtttatcatgtacagtgttaccattctaatcacatgggtttccgcacaaaaaattgatgcgggtacgttacaggttggtgcgatgacagcgtttattacttatgcaatgcagatcgttatggcatttcttatgatgacagcgatgtctattatggtaccaagagcgggtgttgcagcagatcgtattgatgaagttcttaagacagaagcttctgttcagaatgtgaagaagccagaaacgcttaaggagcataaaggtgttctggaattctcacatgtagatttcaagtatccgggagcagaacataacgtgctttctgatattgattttaaagtggagccaggcaagacaacggcaattatcggaagtaccggctgtggaaagtctacgctggttaatctgattccaagattttatgatgtgacaggtggacagattacattagatggcaaagatattcgccggatttctatggaagaactccgagaggaaatcggatttgtgccacagaaaggtgttcttttctcaggaacaatcgcttctaacctgcgatttggaaaagcagatgcgacagatgaggatataaaagaagcagcagaaattgcccaggcgacagaatttattgagacgaaaaaagaaaaatacgacagtccgattgcccagggcggaagtaatgtatctggtggacagaaacagcgtcttgcgattgcaagagcgattgcgaaaaaggcaaaagtacttgtatttgacgatagcttttccgcacttgatatgaagacagatgcagcacttcgtaaggaattaaatgaaaaggtgcaggatgcatctatcgtaattgtagcgcagagagtcagcacgattttacatgcagatcagattcttgttttggatgatggaaagattgttggaaaaggaacacatgaagaactgctgaaaaactgtgaggtatatcttcagattgctaagtcacagctttctgaaaaggagcttggacttgagaaattaggtttggcagaagaaaaagcagagaaggaaacaaataagaaagaaatcctttctacaaaaattgatgagaaagaaaataacaaattaaaggaaaagtctgatgacaagaagttaaaacataagaaaggaggtaagtaaaatggctgaaaataaagcaggaacatcaaacagaggcccaatgggggtcgtggcccgatgggtggcggaagaagaatgatgcaaggtggagagaaggcaaagaacttcagtggttcttttaagaaactcattcgctatattggaaattataaatttgcgattcttgcggtaatgatttttgcggcaatatctacagtattttcagtagctggaccaaaggttatgggaaaggcaactactgcgctggccgaaggcctgatgaaaaagattgccggaacaggcgggattgattttacccgtatcggaaagatccttttgcttactttaggattgtatctgacaagtacagtgtttaactttttacagggatggattatgacaggcgtaacacagaaaatatgttaccgccttcgaaaagaaatctcggagaaaattaaccgtatgccgatgaagtactttgaaagtcgtacttatggtgaagttctttcaagaatcaccaacgatgtagatacattaggtcagggattaaaccagagtgtaacgcaggttattacttcaacagcaacgcttattggtgtcgttgtaatgatgctcaccatttcaccgttaatgacattaattgcatttatcattttaccggtatcggcaatcttaatgtctacagtcgtaaagttttctcagaaatatttccgcacacagcaggaatatcttggacatattaatggacaggtagaagaaagttatggtggtcatctggtcattaaagcatttaacaaagaaaaagatatggtaaaaacatttgatgaaaccaatggagtcttatatgaatccgcatggaaatctcagtttttgtcaggtttaatgcagccaatcatggcatttgtcggaaaccttgggtatgccggagttgctatttccggtggactgttagcaattagaggaacgattggtgtcggtgatattcaggcatttattcagtatgtaaagaactttacacagccaatccagcagattgctcaggttatcaatcaggtacagtccatgacagcagcctccgagagagtatttgaattcttagaagaagaggaagaagatcaggaacacgagggagcggtatctgtagaaaacgtaacaggagaagtgaaattctttcatgtgaattttggctacaatccaaatcagacgattatcaacgatttttctgtagacgtaaagccgggtcagaaaatcgcaattgtcgggcctaccggtgcaggaaaaacaacaatggtgaaactgcttatgcgtttctatgatgtaaatagtggtcagattcttttagataatcatgatgttcgtgattataacagacgtgatcttcgtaaagcatttggaatggtgttacaggatacatggctctataaaggaactattatggaaaatatccgttatggacgtttggatgcaacagatgaagaagttatcgaggcagcaaaagcagctcatgcagacagctttatccgaacacttccaggcggttacaacatggaacttaatgaagatgcaagtaatgtgtctcagggacagaaacagctccttactatcgcaagagctattttggcagacagcaaggtaatgattcttgatgaggcaacatcttctgtagatactcgtacagaggctcttatccaaaaggcgatggataatcttatggaaggcagaacgagttttgtaatcgcgcatagattgtctacgattaaaaatgcagatgtgattcttgtgatgaaagatggagatattatcgaacagggaaatcatgaggagttacttgcgaaaggtggattctatgctcaattgtataattcacagtttgaagaagctgcataatagagtttgaattctggtttgccgcaggcaaggagacgctctcagtaaataaaacaacctatatttgtgactttagtcgctgcggtttgaatactcgcttacacacgctcgtatccaaaccttgctccgaggccacaaatataggttattttatttactgagagctgtctttggaagttgaagaacagtcagaatttatgttttgggcgaattgataagaaaagtatgaaaaatatatattcaaatatttgaatatatattttaggacgaaaataataagtgaaatacactggttttaagatgaaaaaaatcaaggtaaagagtttttgactttaatgctggaataaatttttgccttcttgacatattatttttaaagaggtaagctagttataaaataatagataatatattatctaaaatagcttaaaaacggagattttagataatatattatctgaaaaatgaggataaatataaaaatatgaataagattgagcacaaacaagattgagtatagaatagtggagcgagaaaaggagatacattgatggaggcgttggtttgggaaacggcggaagaacttgatatgaagctggcgcagagggtgcggaatattaggcggaggagaaagatttcgcaggaggaactttctcgtatgagtggggtgagttatggttctgtgaagaggtttgaggctacggggaagatttcattgttgtcgcttacgaagctggcgatggcgttggatatggcagatgaacttcgtgagttatttacacaggttccatatcggaatattcaggaggttattgatgaaagaaaacggaacactacaagttttatatgatggaaaagtagttggaaatctggcgttaatggcaggaagaaagattgcatttgagtacagtgaggaatggctggaaacaggattttctattagtcctttttctttgccgttaaaggagcaggtttttataccaacaaaagagtatttcggcggtttatttggtgtttttggggatagtcttcctgatgggtggggtaatttattattgaatcgtatgttgcggaaaaaaggaatgaagccagaagaaatgacaatgctgaatcgtttggcgattgtgggacagtatggaatgggagcattgacgtatcggccggaggaacatttttcttttgagccgcagggatatgatttagatgatttagcattacagtgccagaagatattgaatacagagtattcagaaaaattggatgagttgtatctgctgggaggaaccagtggaggtgccagacctaagattatgacggaaattgatggagaagactggattataaagttcccagctcatgtagacggtcaggatgcaggagggatggagtatgagtatgctttatgtgcgaaagcgtgtggaattgatatgacggaagtgcggctttttccatcaaagaaatgcaaaggctattttggtattaagcgttttgacagagaaagaatagtagatggaataggaacaaaagtaaaagcaggaaataagaaaaagaggattcatatgttaacagcagcggcattgttggagctggattttgaacagccgagcctggattatcatagccttatgaaattgactaagattttgacgagagataatgaagctgatgtaagagagatgtttcgcagaatgtgctttaatgtgtttgcacataatagggatgatcattctaagaatttcacatatttgtacgatgaaatgaaaaagggatggcgattgagtcctgcgtatgaccttactttcagcaatacttattatggagagcataccacaatggtagatggtaatggaagaagtccagggaaaaaggaactgctggcggtggggatgcaggcaggtctggaaaaaagctggtgcgaggaagtaatagaaaagatgaaaaatacggtggaagaacggttggaaagatatttatagaggtggaagtatagtaacaatatttaaatagcgtataagagtatctggaaaaaagaatgtgacagcctatcttaagtaaaacttaaaaatacttaagataggctctttttttcttttttcatgccgaaataaggtataataaaataataaaaaatgttttacaaaaaagattcttattagtatttttttgtatagaggtttttataaatcaaataagaaaattcagtaagtgtattgctggtgtatcaaatatgaaatgcagcaataaatactgagattggaagatgtttaagaaattattttagaaaggcagatagatttggaagagaatagttcaagtattttagttgtggatgataatccggagattcgggagattatacaggtattgctcggtggtgaagggtatctggtagagacagcgggaaatggcgttaaggcattggagatgttggaaaacagggagtatgatctgattattcttgatatcatgatgccgggaatggatggataccagacatgccggaagatgcgggaagagagtaatgcgccgattttatttttgagtgcgagaacgaaggacagtgataagacattaggattttcgagtggcggggatgattatctggcgaagcctttttcttataatgagctaattagcagagcgaaggcgctgattcgcaggtatcaggtttataaaggaaaggcggagaaagtagagacaccaaagaatttttcctgcaagaatctggttgtggctgaggagacaaaaagtgtatattctgatgggcagttattggagcttacagatacagaatatgcgatattgctgttgcttttgaaaaatagaaggcaggtcttttcgacagagcggctttatgaagcagtatggaaagagaatttctattatggagcggagaatacggtcatggtgcatattcgaaatcttcgaagaaaggtagaaagagattctaagaatccgatgattataaagacctcctggggaaaggggtattactgtgattaaaaaggtacagacaaaggcgaaaggatggaagattcatacgcagttgatggttcttattcttttgacggggctggcaagcattttattgtttgaagttttgtggctgaataagtgggatatttacgagtatgttcagcaggttccggggcttcgggatatgtcacaggatgaagaattttgggagaaactgcggacagaagctgccaattataatattccgtcttctgaagatgataaggagggaattaaaaagatacagccatttcttagtcagggagacaaatatacgggcatttatatttataacttaaaagagggaacctatgtagcaggaaagtttccgagcgtgttaaataatgcggcatttagtacattttttgatatgggttatcagcttaccggtggagaaggtgaggagacatatgagttcccgatgaagtttaaaaatggatacgcaacggtaatggtgtggttttatcatagagtgcgatttatttatccatattgtattttttgtttgacagtcagcatcggattgttcttcggagtgattttatttttcataaaaaagaaaatgaatatggttgcctcgttgaaggatgaaattttgcgaatggcagcaggtaatctccgagacagcgtgccggagatgggtcaggacgagattggaattatcgcagaagaactggataatctgcggacagctctgcaggatactttggttcgtgaaaaggaaagccgcagggcaaatcaggacttgattacagcgatgtcccatgacttgagaacgcctttgacaattttaaatggatatttggaagtacttcgattaaaccgaaacccggaaatgcatgaggaatatctgaatcgctgtctgcaaaagacaagtgacatccgggaaatgacggacagaatgtttgaatatgcactggtatttgaggaggtagatgatccgaaagtcaaggaaataccaatagaatattttagagattgcattaatgaacatagtgactttatcaagcttgcaggatttcagccggagcttgattatacgaatgtagaaagatggattactggtgataaaggaatgataaaaagaatattcagtaatcttttttcaaatattctgaagtatggagataagtcggttccagtaaatataaaaggctgttttacaaagacaacgtatatacttacaatgtcgaacggtattaagcagcaaagtacaggagtggaaagtaatcatatcggtttaatgagtgtggaaaaaatgatgcagcagcttgggggaaagagttcattttcggaggaaaatggattgttttctgtgagattggagtttcatttgaccgcatatggaagagttgacagaccagagacttactcaggaaataatgcaggaattatttaagggaaaatcagttctgactcaaaataaaaagccttgagagaaaatcaagaagatttcacaaaatgttcacaattttttagcactcaacacttgacgtggctaataataggtgttatattacagctagaacaaaggagaggacataaagagataagaaaaagagttccaaaccaaagttcagaaaaatcatttcaacatagtcgaaagaaagatgcttccgatttgctgaagacagtaaaagagtttgaaaggagcaatgacttatgatgatgcctagtatttttggagagaatttatttgatgattttgatagctggtttagtgacccggttgaaaagagatttttcggtaagaagaatccattgtatggaaaacatgcaaagaaccttatgaagacagatgtaagagagacaaagaatagttacgaagtagacgttgatcttccaggatttaagaaagatgagattaagctggaacttgacaatggatatcttaccatttctgctgcaaaaggtttagataaagatgagactgacaaagaaaccggtaagtatatccgccgtgaacgttacgcaggtaatttatcaagaagcttctacattggagatgtaaagcaggaagatgtgaaagctgcatttaagaatggtattttaagtatcagcgttccgaaagaagataagaaagcaaaagaagagaagaaatatattacaatcggtgaataattccttaacgtttattgagaatcgaataaaaaacttgaaaataaagtttaataaaacaacagatgaccgaaaggaactctgatgaaatataagtgaacaggttaataatacaggtgaggattttaaagcagaattagtaatgaaattagtagcttgaataatagattaaaatataattttttaaaattgattatttaagaatccgttatttaggattttatttgaagggagaaatgacttatgatgatgcctagtatttttggaaataattttgtagatgatgtatttgatgatatgttcccattcgcaggaaattatacaactgctaactatgatttgatgaagactgatgtaaaagacgctggtgaccattacgaacttgagatggaaatgccgggagttgaaaaagagaacatcaaagcagaactgaaagatggttacctgactgttaccgcacagcagaatactaacaaagatgagaaagataaacagggtaactacatccgtagagaaagatatagcggaagctgccagagaagcttctatgttggtgaaggtgtaaaacaggaagatttgaaggctgcatttaataatggaattttaacggtagcagttccaaaagaagtgcagaaaccagtggaagaaaaacagtatattactattgaatagtgattttttaaaatagacagacgaaaatagaaccctcataccgtcctatctgtgactttcgttgcgatgtgttgaatagtcgcccctatactcgcatccaacacttgctcccagtccacagataagacgatatgggggttttattttttgctttttcataaatttgaaatcactattcaaggttggtggatttgagggtgtctgtctatttaatgagtcgaatcagcaatcttttggaaaagagttcttaccggatgttttaatttggtttttaaggtggatatattttcattttgcaattcgatagctttttctaattcaaggatatgttgttgcatatcttcattttcttttcttaaagaaatagtagtgttgccgaggacacggataatatcctcgcacatatgtctggaatcccattcccatttttttatgtttttgaaattcgttttaaataaatcttcggagcagttaaaatatttttccatgattctacggttgctggcacgatagttttccatgaaggcagaagcttcttcgggagtgaacattcccagtttttctgtatcggggtcttccgatgaaacttcagagagcatatgataaaagaaagaaaaatcttttttggtagcgttagggatgctgttaaagattcgctgcatttcattagagttaccgctcaaacgagggttacgttcaaaggtggtgattgtataatcatctgtcagggaaagactaagtgtgcttaaaaaatcatcataaatagacccatttttaaaatattttttaccatagcggcggacaatgatattttcggagcctaattcagaagcgatttcatttaaaccttcttcataatctaaataaatagctggaggagtggtattaatgaattcctcccatgacatagaacggaaacgctgtttggatttctttattttttgattccacatggaatttaaagcggcatcttgtcttcggagatacacaatgatttttattttaaatgcacttttaagagattcttttcttaaaatttcccacaaatcttttttgaaaaaatgtgtactgtgccagatgctttcatcggaaagaagaatgttattatatttagaaaacatatagataatatgatccatattgaaacgaaaaattctgtgttcgtctaaagtattgatttttccattggaatcatactgatgggcaataagaaaatgtccgttgcgatatggattgacatctttatatttttgttcaaaaataggaaaatatattccgttttttgagagtatttctttattttcattgcaaaaatattggatagaagtggtggctgttttgggacagccgatgtgtatgtataatgttttcatgttatcctcttttcattctttttttatttattttgcaacgctattcagaatcctatataatagaaaactatatgttaaaatctataatttcaattactcttggctttgacgaattatgtctaatatatctattcttttgatagaagtgctgtagttggcaagtggattctgaatagctgttcataatttttaacacggagaggataccgtagaaacattaaaataagattaaagattttagaacgtgtttaagcaagagtcagtcttatggtacagcttccttttgcaagagagaatgaatcttttgcgtggatgactggaaagtttgggcgattaattcaattattgagaacttttatctgaaggaaggctaagtgtaaaaatagaacccactcccagttcactttgcacacgaattgttcctttatgcagttctataatcttatgtacgagagatagccccaacccaaatccttctgtattgcgagatttatcagctcgatagaatcggtcataaatgtttttttttgtttcttcactcataccacagccataatcttttacttcaaaaaaaacatagtctttttctttccataatttaagtttgatagaagatttatttttgctgtatttcattgcgttgtttataatatttttcacggcgatagccataaggcctacattcatataaatggatatatcatcaagattagaataaatcgttatctgttttttaaactgaagtggttccatgtcacaaacggattcaatgagtgttttaaagttactatactcaaaatcatcttttatgcgtccttgctcaagacgggaaagttgaagaagttgtgagatgatttcagttgttttcgtattttgacgttcaattacggttaaagattccgtataatcatctatgttttttccatatttttttaaatactgacattcagcagatacaatggcagaaggggttcggagttcatgagcaacatcagaagtaaactgctgttgttgttgaaataaatcttctaatctgtccatcattcggttgtttgcctgaatcatagcatctaattccttaaaaggagtggtatattctatacgtttagccagatcaccatcagtcccaatcttatcggcagtatccttgatttttttcataggtatagtcagctgggaagaaacaataccaataagtaaaaagccgataaaagcaattacaaaagtaaatgtataggaaatgtatttcattgttttatattggctgtcaaaatcagatgcctttccgatatttcttacaataacaaggactcttttatttgttattgtatctttttttaagtatgggcgatcgtaaatatagtaataatcggaagaacattttactttttgaaaatgccactgattaacagggatattttttaattttttatctggatagtgaccacggaaaaaatctccctgactgtctaaaataattttttgtacatgatcttcctcaaaaataaaatttttattcacgaatatttttccattttgtatatcaatattgagaaaatcatagtgtgtttctttcctgatttgccgtcggatgtcaaaataaatggttttatttgagaagtatgaaataaaaagaatcataatagccgccatgataaaaataatagcggaaaaacgtatagaaatataatgagtaatagcaatttttttattttgtttcatgatttctcctctatttctgataaaataaatgtgcattaatcaggctcagttaacatatatccgattccacgaactgtctgaatgagttttacatcaaaatcatcatcaatttttttgcggagataccgaatgtacacatcgataatgttagattcatcctcaaaatcaagtccccacgcattggattcaatctgtaagcgggaaagagcgatgtttttatttcttaccatgtattctaaaatagcgtattcctttggggagagttcaatatctgtgcctgctcgtgttaccgattttttatccgtatctataagtagatcagcacattcgtaggtagttccgtgttcctgtgggctacgctttatgataacacgaagtcttgcgagaacctcctcaaaagaaaatggttttacaacgtaatcatcggcaccgaaatcaagaccagttacaatatcctctgtctggtcacgggcagtcagaaacataactggtgtttcaattttctgactgcgaatctcttttaaaacttcaaatccatctttaccaggaagcatggcatccagcaaaatagcatcataactttcttctgtaatataatagacagcatcattgccgttaaagcaggaatcaacaatgtatccttctgcctgaagatgctttgcaataatgtgatttaagtctggttcatcttcaactacaagaattttcataagtttttcctttcttaattttaatgaattactatgatttaatcataacagatttcttgaaaataaagaaataatatcataagaatattaaaaaaagattaaaggtagaaatttgtacataacatgcaatttgtatgtaaaattcttgtaatacatgaaacgctatgttagaataattaaattagaaaattatgaggaaatctcaggtaattcaattgctgaggattttacatttaaagagatgtactatcagagaatttcggcacttgttttgtcgattgattctctgaaaatatataggaatttaaaggaggtttaggaaagcgatgaagggattgtttatcattaatccatcttctggaagacagaattttattgacaagattaaggagatagcaggaatgctggtcattgaccagatatgcaatactattgatgttttctatacagaaaagcaggacgatgctctgaataaagcggcagctctggaaaagggacagtatgactttgtagttgctgttggaggagacggaacgcttaatgaggtgattaatggtgttgtacttagccagagtaacactccggttgcagttatttcggcaggaacggttaatgactttgcaacttatctgaatcttccacagacaccgaaggaattctgtgatatgatagcagattttaagcttaaaaaggtagatgtcggtaaagttaatgaaaaatatttcattaacgtagtagcggcgggtcttttatctgatactggatttaaagtatcaaaagataaaaaggcagtaatgggtaaactggcgtattatttagaaggagcggcagaacttccaaagcagttcggaaagagctggaagatgaagtttatcacagacaataagacggtagaagaagagattctgttatttatggttgcaaactcacagagcgtaggaggtttccgtgagattgcgccattggcatctgtttcagatggattatttgatattatcattataaagaaaatggacattttccagatgcttccgcttatgctttctattctgcagggtgatcatgtaaatcatccatctgtggagtatatccagacaaagaagctgcatattgagaatctgtctggggaagaagtcaaagtagactacgatggagaggaactgccagagggattcccagtggatatcagtataataccgcaagcaataaatattgtggttcctaagtaaatttgggattgctgcaggcaaggtagacacccacagaaagagaaataacctatatttgtgactttcgtcgctgcaggttgaatgttcgcttaaccgctcgcatccaacctttgctcccaggccacaaatataggttatttctctttctgcgagctgtttgttggctgttggagaatctgtagctggattactataagaattagaatttgattaggaatcagggagaaatttgcggaggcgtcgggaggtagtgattttaaaatcttaatagtagatatcagctttaatccccctcaccaacacactttataaagcagatcaaaattgctttggggaaattatgaattccaatttctgattttactccagcggccacagtcagaaaccttgtctcttcggtcagttccagaaaaacagaagttacaaaataatagttgcaaaggaactcattctgctttataatagacaagaatattgattcgttgcgatgagagaagctacggtatgaatgtttttcagagagctgatggttggtgagaatcagcaggcggaagtacctttccactttttgagcattgatgaaagtcaaaggctggtatcctttaacgtaccaatgagtggctgttatggctttatatgtttatacattttgatatatttagatataatgtattctagtatgatttgatatgtgtcagatatatttaaataatatagatgtatttgaatatgttagcaaggacagcaatttgggtggcaacacggaattcttcgtcccatgagtgagggtagaagggttctttttttgtttgtaactatttaaagcaaaatattaatagtttttgatagttatgtcgatattaatatttaaatgaaacccagaatattttctaacgtattttcgaaatcttagccgcaaaagtaagagggaaagacttcgggaatattctaacaaaacaggaggatattgataatgttagatttaaaatttgtcagagaaaatccagaggttgtaaaacagaacatccgtaataagttccaggatgagaagcttcctttagtagatgaagtaattgagttagatgcacagagaagagcaactcagcaggaagcagatgatttaagatcaaacagaaagaagatttctaaacagattggtgcgttaatggcacagggcaaaaaagaggaagctgatgctgtaaaagagcaggttactaagaatgcagagcgtcttgcagaacttgaaaagttagaggcagagcttggagaaaaggttaagaaaatcatgatgattattcctaatatcattgatccaagtgttccaatcggtaaagatgacagcgaaaacgttgaaattcagaaatatggcgagccatttgttcctgattttgaagttccatatcatacagatatcatggaaagatttgatggaatcgatttagacagcgcaagaaaggtagctggtaatggattctattatttaatgggagatattgcgagacttcattctgcagtaatttcttatgcaagagacttcatgattgacagaggatttacttactgtgtacctcctttcatgattcgtagtaacgtagttacaggtgttatgagctttgcagagatggatgcaatgatgtacaaaatcgaaggtgaagatttatacttaatcggaaccagtgagcattccatgattggtaaattcatcgacactgttttaccatctgatacactgccaagaacattaacatcttattctccatgtttccgtaaagaaaaaggtgcacacggaatcgaagaacgtggtgtatatcgtatccatcagttcgaaaagcaggaaatgatcgttgtatgtgagccagaagacagcaagatgtggttcgataagttatggcagaataccgtagatttattccgttctatggacatccctgttcgtacacttgaatgctgttccggtgacctggcagaccttaaagtaaaatctatcgacgtagaagcatggtctccacgtcagaagaaatacttcgaagtaggaagctgttctaatttaggtgatgcacaagctagaagattaaaaatccgtgtaacaggtgaaaaaggtaaatactttgctcacacattaaataacacagtagtagcaccacctcgtatgttaatcgctttccttgagaataacttaaatgaagatggttctgtaagaatcccagaagtacttcgcccatatatgggaggaaaagaagttctggttccagtaaaataaatttgccgcaggcaggggagacgcctccagggaatgaaatggtgtgcatcccgtcaagtagacaattaaaaaaatataaaatttttgtgttgcccggtgtatatcgggcaacatttttatgccgccaatcgttgcttttcatgaaattccattggtgttaagactccaagtcctctctgtggccggtcgtttgtatagtaatctatatattctgtgattgccttctctaattcttctctgctctcaaattttttcccataatacatttcccgtttcaagatcccccaaaagccttccattactccgttatctgtacagtgtgctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtgccgcagcttgtcatttaaccttctatatcccatatctggatgtttttcatggaatcgttccagcttctctgccaattcctcgttaaatctctcattcggtgtctctgcatgatggagccatttgtagtaggatgacctggcgatccctcctatttcacataataacaggattggatagttatatttttcgtgttctttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagtccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccaaaataatctatatttgtgactttagtcgctccgaggccacaaatatagattatttcattctctggaggctgtctttgcctgcggaagtaaggttgaattttatgtttacatttgctcagggtaacttctttttctttgagaggatatttgaggattcttcaggagattgtgattttaggaaattaagtggaaattctcacataatatcttttacccgacagtatttcttcagattatcttcatttttttctcacaaactgttcacaaatattcagtatgatagaaacatcaaaagaacaaagaattatttttttgatagatttttttcatactttcctctcttagaaccgttgaacagacggttctttttttctataagaaaagtaaaagcttatatgtggtgaataataacttaaatccttaaaatatagactattgtaatatccattcagtaacaacactttagaaatcacatagataaagaactattatgaaatcacaaccttctagagaattcccaaattcctttcaacgcagaaaaaaatttccagcagcaaacaagaattcactgaattctgcctttgccccaacagccaaaaacagcatacagtaaataaaataaacgatatttgtggcctcggagcaaggtttggatacgagcatgtataagcgagtgttcaaaccaccgcgactaaagtcacaaatatcgtttattttatttactgtgtgcgtctccctttcctgctgcaacccagaattatttcttcttcctccgagaaattcgattttttctgcgtttctccagctcatgtctgtgaatcaggtgcatgatcaggataataagaataactgcgactaagagtctcaaggagaattcaattcctttatgtatagcatcttttctttttgatgctacaggggcagtttttaaattatcgtctacggttttgccttcctgataagcttttccctgtttagaagttgtgtcataggtaacttctgtctgtccaagttttttgccatcacaggagattacgatgtaaccaaggcggccagtttttttatcttcatcgagtttaaaagcggtttttaaatcagattcattaaagtctttttttacaagaacagagaagtttttgtcataaacagagtttaaaagctgaatctggtcgagctttgaagagtcaatggaggtatttgctgtcatggcagtttttaaactgaaatcagtaagcggagttacggattttacctgattaaaagcccacttgaataagttagcagtgtctgtgtagcttttgtctgcaccgtagtcttttaaaatgacgcagataagttctacattatctttctttgcgtaagtgactaaggtattgagggcaacctgagtgaatccagtttttgctccttctgcatatttgtagtagtagtcactgttttcacgaagaattttagcgtgattccacagctctaaagtatcttttaaagtgtcacttttctttaaggtgtaggaaatggttccggaaattttacggaattcctcatgcttcatggcttcttttaagataaggcccatatcgtgagctgtcgtgtaatgttcttcgtttggaagtccatgagggtttttgaactgtgtgttggtacagcctaattctttggcgcgctttgtcataagctttgcaaattctgttgtggaaccggaaatgtgctctgcgatagcggcagcggcctcattagcggatacaagcattaatgcataaagactgtcttctacagtaagcttggcaccaacattaattccagcggtactgctacctgcctcaattccgttaactgcagcattggagtaagtaataacatcactcattttgcagttttcaacagcgagtaaagcggtcataactttagtgatactggcaggatatctcttggtgtctgcctcttttccataaagaatcgttccggtattggcatccatgacaacagcagattctgctacgatatctggtgcaccgcttaaattggaaattccataggaagcaccagcctgtacttttgaagtatcggtctgcgcttcggaagtgccagcctgtgtttttgaggtatccgtctgtgcctcagaagtgccagtctgcgtttcagaagcagtggcagtagttgccgcggcaaaggaattcacacaaaagcttaaggccaatgttagtgtcaatataaacgtaagtattcgtttcattgttaaatctcctttttattttgccctggagcatttttcaaacacgctctatcatgcagtattattaatatgctgatatactattgggctaagtctttgagttctattcggtcatttcagaccttgcctctcattgtatcctacttccatagaaaaagcaaaaattaattgcaaaaataatgtccagcgattagaataatactgtatgtctaaaattgcgtatagatatagaagaaaatatattaagatagatggggagaattaaatgagattaagaaatgtaaaaggttcaagagaacagattgcagcgaatgaatatacaattaaagacgcagagcagattaaaggccagtggaaagattatttccaggatggtaagccgattcagttagaaattggaatgggaaaaggtaaattccttatgcagttagcagaaaagaatcctcagattcattatattggaattgaaaagtattccagtgttttggtcagagcattagagaaaatggaagagaatcctttagagaatcttcattttattcgaatggatgcagagaatattgtgaatgtatttgaaaagggtgaggtagatcagatttacctgaatttctcagatccgtggccgaaagaccgtcatgcaaagagaagacttacttccagacagtttttagagcgttatcataacattttaaaggaagagggaagagttatctttaagacagataacagaccattatttgatttttctttagaagaagtaaaagaagcaggatggacacttgagaaatctacatttgaccttcatcacagcgaatatgttgagggcaatatcatgacagaatatgaggaaaagtttgtggcaaaaggtaaaccgatttgtatgcttcagatttttttgcaggaagataaataacaacattccctgtctttatcataagataaaacaggggtggaattttatgaattttaaagagaaaatgtgctggaatattcagcgaaagagcctttgtaatagaggaatctggcggtgtctgtgtaatttctgccagagcatttcagaggtatgcagaattttaaatggcaaataatttactttacgataaatgaaaggattttatttatgaaaaagattgtagcaatcgatttagacggaacattattacattctgactgtacgatttcttcttattcaaaagaagtaattgcggaagcagtaaagaatggaattatggtagttccaacatcaggaagaagttttcgaagtattaagaatcaagtgcaggatatcgaaggtgtaaaatactgcatctgtgcaaatggaacattggttggaaatattcagacagaggaattgcttcacaattgcaagataccacagcatttggtttatgatatttataaagaagtaaaggaaagacatggttttatagaactttactgtgacaatgatgcctatgtggaaaaagatacagctccgattatttatgatactaagatgggaaaagatttctgtgacagtatgttatctacagatgtaattggcctgtcctatgatttgcttctgcgccgtggaacaatgcgtatcaataagatacatgttgcatttccagatccacaggaattaagagaatttgctgcaaaaacagcagaaaacaaaaatcttatggtaacatttcctagcgaatataacatggaaatcttcccaagtggctgtaataaagatgtgggaatccgtatccttgctgaaaaatataacattgcacacgaagatacggttgccatcggagacagtgataatgatgtggcgatgattgagtatgcacatattggaattgccgtagcaaatgcaatggaagtattaaaggaaaaagcagattacatcaccaaatcaaatgatgaagatggacctgcgattgtacttaaaaaaatacttgaaaaataaaaaataatgcttgcaatctatgaaaggttgttatataatagtccttgtcgttgagagatacgaaaacaaaacacaaggatatgcgcttttagctcagttggtagagcagcggactcttaatccgcgtgtccagggttcgagcccctgaaggcgcattacaaagtaccgtttttgggatttagacctggggatggtgctttttttgttatataagaattaaacttatgtcgatacatccccgatttacgatggaagaccgaccgatagtataaaaaccgtggcagatcagataaaaaaagaagaaaaaacacatatgccgaaacaatttaatttctggattgtggcatcaggagatgccgccaggaagatttgtaattatttgtctaaacagattatctatatgagaaataatcaatataagaaaacgttctacacgttgcaaagggaaatgttgctgacaggagaggtgtagagcggaggaaggtaaatggataaacatttgaaatattttaattttaagatgaggggcgtttggagtaagatatactataaagaatagcataaagcactgttttggaaatttaaatccaggacggtgcttttttattatatagagtgtgtttgaaaaaataaaactattcgatacaaaagttttgaaaaattttttttaaattagtgaacctttttgcagtttgcttcgtataagagagtgaaaagaaaaataattaggaaataaaaaggactccgggggtgtaatagttaaaaataaaggaaattaaaaacaataaacaaaagtaaaaagaaagagaggatgctaaatatgaaacagagaacaatgaaaataacaaaaaatataatatgcatgaccagtattctggtactatttattttgattaaaccaacaaaagtatatgccttttccatgaatgaagccagaaattcaccagtacttacaagtcaatacagaacaacaagattaagaaatgaatatgacgtaaaattatttcaggtacagatgccaaaatctggttgtttcagaataactttaagacccaatgctgttgcagatgagaatgacataggatatggatggaatcttaatatctatcgcaaggacaatttgaaagaaccagttaagcaatattggcagattgagaataagatggttacagagaaacttgttttgacatcgggaacatattatatagaagtaaaatcttatagtgaatatggaatgtcacctataatggtaccttttgatataaaggctgatgttgtttctgaaaataactgggagcaggagaataataatacttttaaaaaagcaaataaaatctctatcggaaaaaaatatcagggaactttgtttgatgatatagatgaagactggtttaaagtagttgctccaaatacagggagaattacagcaaccttaaactgtgatccggatacagatgtaaatgatgttggagacggatgggatgtatctgtttattcagcaagcgatatcaatactgaaatagcaaaagaagagtggataataacgaaaggttctgtcagatttaatgtggtaaagggaaggacatattatatttatgtacacagttatcattattcttttccagaaggttacacttatcagttagcgacttcttttaaaggaccaaaagcaactccagccaaaaagactacaaacacatcgaaaaaaccagtgaaaatggtaacaggtgtttctttgaaagtaaagaaaaagaaaataaacattcgttttaagttagtatcaaatgtctctaaatatcagattatgtacagtacaaaaaaatcttttaagaataaaaaggttgtaacagtaagaagtggaaatgtgactataaagaaattaaaaaggaaaaagacctattttatcagggtacgggctatcagcaaaaatggaaaagctggtgcgtggagtgtagtgaaaaaagtgagagtgaaataatatttctgaatcactatttttagagaaaatcttaagatgtaatgcaaaagaaaggatgaaaagatatgaagaaaagaacaaagttttacgcattattatttgcaatggtattatcgttaacacagatgatcggagcagcagttccagttaaagcagcaacgaaggaatgttcgcatggctatactttggtgaatggtatcggtatacgtatgcatgaatgtggcgagtccgtatgtattacctgttatcatggacattctaaacgtgtagttattccgaaaacttttaagttaaatgggaaaaatcttccgccaacacaaattgattgggctgattgtggtttctctgaaaatggggtaaaagaaattgtgattccagatacattagattatttgggatattgggatgaagatgaagttaacacaagctataaagatattacattttttgtccataagggaagtaaggcagcaaaagctgtacaggcagaaggctataaatatagatatttaaacgacaattccaacccacagccagtaaaaggcacatcaataaaacgaaccgtcagaatccaaaacctgaccaaaatcacatggaagaaagtaaaatgtgataaatacgaaatcagatattctcagaaaaagaatatgaaaaacgcaaagaaaataaactgtggcaaaaataaaacatcacttgtcattaaaaagttaaaaaagaatagaaaatattatgtacagattcgaacaaaatcaggaaagaaatattctgcatggtcaaaggtaaagacaatttcaaaacgataaaatgcagaaaaacaggaaagacctccttgcactgttttggggaaataagtatactattatcgggcagccatctggaaaatacgttttccagatggtatttaaggattatatttaataaatttacaggaagttataaggaattataggacttgtaaaaataccgaggaggaagcatattgaatctgatttttgacttagatgatacactttataatcttatgggaccatttgaactggttcacaaaaaattatatgcagacaagacggatgcagactgtacgcagttgtttatgcagtcccgtgtttattcggatgagattatggaggcagagaagaagggattaattccgcacgaagattgtttttatgagcgtgtgaaaaggacataccatgatgtgggaattgagatgagcagagaggatgcggatatttttgagcagttatatcgttcctttcagaaaaagattacacttggtaatggagtagagggatttcttgattattgtaaaagtaatgatatttttattgcgattctcacaaatggcagaccagaaccacagtatgcaaaggtagttgcgctggggttacataaatggtttgatgatgagcatatatttatttctggcggtattggatatcaaaagccagatccacaggcatttaaatatgttgagaatgcatatgcattaaatccagaagaaacatggtatgttggggatacctatgaggcagatgttgtcggtgcaaatacagcaggatggcatacgatatggtttaatcaccgaaatagggagtgtccggaaaaaaaacgggcagatattacagtaaagagtatagaggaattaaaagaagttattagaggacagatcggataaaatcggataagggcaggaaggtatgtattgtagaagttgcagaaaatggtttccaaataatattttgttttgcgatatctgtggaaagccattagttaaagatttagatatatatggagagaacttttttaatggagatgttcaggcatttgattatatttaccagaatagttataactgggtagcaggggaagtaagaaaaatgtttctggctaattcatcagaggtggaggactgtgttcaggaaatttatcttctcttatatcgaaaaatcaaatactatgatcctcgccaaggtagttttagtgcatggtttaatgcgctggtgcgaaacagaatttatgattatggaagaaagttagcaggaaatagagaaattctgccggagaccagccagcaatattttaaagagataacagatagaaatgtttatattaacccagaagcaagaatagaatatgcagagcgggagcagattcttgatgaaattctcgatgatattggagagggacagcgcatatgtatccagatgtattataacgacggattaaaaataaaggaaatcgcacagatattaaatattagtgagggaactgtaaaaagcagaatacataacggattgaagaagttaaatacgaaggtggatgagatgcagaaaaggggactctacacatttcgtatgcttcctcttggattccttttatggctcttatccagagacgattgcagtgcaaaagaagattacagagcattataccatgccagaactctggctgggcaaaacgttttacagaatgcgccaatggctgctggaaataaagctgccggaattaaaatggctagaagaaatcaaaatgttgtaaaacatgcaagtatgcagcaggcaggtcaggcaggtgcaaagcatgctgcgataaatcatgcggcgaggacagcttccagagctggaggcaaagcgataaaagctggaatggtaaaagctttagccggtggtattactgcggcggtcataggaagcggtgtatttattggaggcaaagcattaaagcaacatcagggcgataagaaagtaatcacttctggtcaggaatatagtacgcaggaagaaaaagagggaacaccggacagctcggtgaaagaatttgtggatgataatcaggcatttattaaagaaatattggctctggaggcagaagtaccagaaggtactgaattccagacggatataaatgaaaatgtcaggagtgtggtatatacttctttgggattattgtgtgataataagtcttttggtgaggaagctacaaatatatatgatgcggtaccagaggaaagtattgtggattataataataatgatgatggtgagggaacgatatctgtcgaagagagtggatttgaaaatatgagacagtttcttggatgtaaagaaacgattgggtcattaagtgctacgagtagcgaagaatttctatgtcaggatggagaagtaagagcagagggcttaagcccatcgtcagatatgcagtcatccattaaggatattgtgtatattccgctttctaatggggatgaacgagcaatttttacagaacagattatacaggatgaaatagacggcattggtacagcggtgataacaaaagcagataatgatctgggtgtacaattgaaaagttataatattgttgcagactccgacaagatagaccagttactgggaagtgtagctgtcctcggaaaacagctgggaagtgatggaaaactatttagtggtaatatgacagagatgtctgatgagtccaaaatacatgcacttatagattctgtacggggatattgttatactgagcctaatgatgaggatatttacgctaatagggcagaaagcctggtttataagccagtattttccgaggatgatataaaaagcaatacagaaaaatctattattgtaaaagaagatgcattcgatgattatctggcacttgtagactatgatggaacgattgatgatatagtagcgaataaagcgttacaaaataaatataattgtagtataaagagaaacggtacgaatatagaattcactttttcaggagagtttgaaatgacctattggtgggtagaaacggatatgattgatcaaattaataaagatggatttaagatactcaaaaatggaaaaatagaagtggattgtctgttatatacttcacatgcaacagaacctgatccaggagtggaatacaaggcaacgctgtcattaaatgaggatggttctggaatgaaattagaaaatctagagcgtgtttgaaaaatgctttctggcaatccgactactactattctcagcggagtctccgttgctacgcaaattggaaattgtaaaattcgacacattaaaaggtaataagtggttatatatttaccaaaataaaacgtgtaattttttataaatatgaaaggtttttttcttaaaaaattaagattgtgcgaaaaagtccatttacaacgagcagaattgtgatataataaacgaagttcaggcaaatgttgagaattataatcaataagtgcttgcacaattattttagaaaatcagcacagtgttttcacagaaattttcttgtctacctgtttgtaattggttgtgaacataatctatttgatacagccagataaaaacctttctgtctaactgatgttcaaagttttattcagcctgttatctagttttatgtagcaggttcttttaacttttattttctattatctagagtttattttacctatttaaaattaaacattagagcgtgttttagtatactcagggaagcgcataaaaaataagaagaatttacaaaaagtattatgtcttgtaaatcagggcatgtttttttgttgtggagatttttatgaaagagaagaagaaaaggttcaagcatgagcatggaagcagcttttcggtagattattatgcgtatgcatcacatatgagaagctggaatgcaggctttaaagttctgttttctattattagtctgcttatatgtattgcatgcaataatctgtttgtttcgctggcagttattttctttatgggatttttgacggtggctgttggtggactggatttacatcattacattacgatgctgcttgttccgattgtatttttaatttttggaacaatagcgatagcgattggattttcgatgcgtccagtaggacagtatcatgttcattttttgaatttattttacatttactggtcaaaggcaagcttgcttaaggctggaggtcttgtgtttaaggcattgggagctgtgagtgcactttatatgatgacacttactacaccgctgagtgaaattattgcagtcttgagaaaagcacatattccaaagctgattattgagcttatgaatatgatttaccgttacatttttattatgattgatacacacagccgcatgaagaattcagcagagtcacgtcttggatattgtgattttaagacttcctgttattcatttggccaggttgcaagtaacttgttagttgtgtcattgaaaagaggaaataattattacaatgcgttagaagcacgttgttacgatggggatttacgattccttgaagaagagaagccgctaaaagcaggccagattgtgatggcagttatttttattgtagtgttactgcttatatggttttttacgagataagataattttgtcagataaatcggaagaatactttatcataatttcgtaaaatatatcagatgtgagatgactcccacatctgtaggtggcgagcaacaaatgagtatcaggagatgtttatgcaggaaaaagaaccaatcttaaaggttgaagatttacattttacatataatggagaaaaaacggcactgaatggagttgaccttaatatttatgagggcgagaagatcgcggtgcttggctcgaacggagcaggaaagtctacattctttttgaatattaacggagttttgaagtctcatcacggcgatatttattatcgtggtgagaagattacaaagaaaaacttaaatgatcttcgaaagaatgtcggcattgtttttcaggatgcggataatcagattattgcgtccacggtaatggctgaagtttcctttgggccgatgaatctgaaattaccgaaaaaagaagtgatttccagagtggataaagctcttgaatatatgaatatttcagaatttaaagatcgtccgccacattatttaagtggtggcgagaaaaagagagtcagtattgcagatattattgcaatggagtcagaagtcatcatttttgatgagccaacagcggcgcttgatccattgaatgcggcaatgcttgaggaagttcttcagaaaatgggtgatgaaggacggacaatgctcatttctactcacgatgttgattttgcttatcgctgggcagagagagttattgtattttgtcatggaaagattattgcagatgatacgccacttgctgtatttaagcaagaggacattttgaagcaggcaaatctgaaacacccaatgatgttcgatgtctatgacattttaaaagagaaaggtatcgtccctgatggggacgtttatcctaaaaatattgccgaatttcaggcaatggtaaaaggtttataaaatcgtattttagggatctcctggttccagaaatacacaaaaattaaaaggaggaaagacaaatgtctaaaaaacagaaaaatcttgcggttcttgcaagcgtatttttaatgcttttaacaatcgcgccagtttctaacgcaatgcacatcatggagggattccttccagtaaaatactgtatcttatggggagtaatctgcgtaccattcttagtaatcggtttcatgaatattaaaaaggtacttggaaatgacagaagaacccttactgtacttgctttaacaggtgctttcgtattcgtactttcatctttaaagattccatcagtaacaggaagctgttcccatatgacaggtacaggtcttggagcaatcttatttggaccatgtgtaacaagtatcttaggtattatcgtattaattttccaggcaatcttacttgcacacggcggattaacaacattaggagctaactgcttctctatggcaatcgctggaccaatcatttcctggatcttatacaaattacttcagaaagcaaatgtaaataaacgagtatgcatattcgttgcagcatttttaggtgatttatttacatactgcgtaacaagcttccagcttgcacttgcttacccttcagaagttggcggcattggagcatctatcgcaaaattcctcggaatcttcgctacaacacagcttccattagcagtaatcgaaggtatcctcactgtagttatcgttattgcacttgaaacatacgcaaaagacgaattaagcagtcttgaattttaattaggaggagagaaaatgacaaaaaatacaaagacagtaattattttattagtaattgcagcattaatcgcaatcgtaccactgttcgcattaaagggagcagaattcggtggatctgatgatgcaggtagcgaaatgatttccgaaattcagggaaaagaatatgaaccatggttcacaccagtacttgaaactgcactcggtggagaacttccaggagaaatcgaaagcttaatcttctgtcttcagacaggaatcggagtaggaatcgtagcatttgtattaggacgattcgtagaacgaaagaagtggcaggacaaggagaatggagattcgacttcttctaaataggctatagatagactatagacagacaaaaaccgaaaaagccaatcctcatatttgtgaaagtatcactgtgggttgaatgttcgcttaatggccacaatcaatcctcgctctaatatcacaaatataaggattggcttttttggttttctgtgtgtggggatcgtctgttctatctatccgcaaaatttctactgacttgttaaccattcaatcgcattaagtacctcctccggtgtttcgcataccgagaaaagtgactttacggactcgcggatgaatcccatgccgatgagtttatcgatgatagcgatggtgtcatcgtaaaaaccggaaacgttgtatacgatgattggttttgcacttcggccaagttcggttaaggtaagtatctggaagaattcatcgaaggttccaatgccgccgggtgcgatgacaaatgcatcggcgttctcttccatgacttcttttcgaaggctcattgtctctgtgcgtacaatttctgtacactcgcttttaatcggttcaaacttattcatgaaagttgggacaacacctgttacttctccgccgttttctaacacaccgtttgcacaggctcccatcagtccgctggcaccgccgccatagattaacttgtggtgtctttttgcaatttcttttccaagtgcttctgctgcatttatatagatggaatcgatgcggtcgcttgctgcaccatacatacaaattgtaagtttggtcataatagcaccccctcttgttttatttgtagagcttaattttagcatttaattcgacaaaaaacaacaaaataatagagaaaaacagataaagtggttaaattgtctatatattataggaaaatgataagaattatggtgactatttatgtgatgtttgtaaaattatatagctgatgctacttttttgcttagagcgtgtttgcgctctagagtgtggttaaaaaatatttctacagagatttttaaaatatattcttttgctattgtatgaatatagaaaataagaggtgcataaagacagaaaaattgtgaaatatgcttgtttttttatgcaaatatgctacaatatagacaaaggtattcataattatacatgtcgatattgaatctgatttacgattaaaaggggtgatttttatgaagaaaattataacgatcagcagagagtttggaagtggcggtcacgacattggaatggaagtagcaaagcgtctggatattccattttatgatcatgagatcgtagataaggcagttgcagagagtggatttacaaaggaatttgtagaggaacacggtgagtacagctctctttcttctgtattactcggaacatcggcaccatttgacagttattattatgcagaggacccacaggataagattttcaagattcagcgtagaatcattacaaagtttgcacaggaaggtccatgtgttatcgttggaagatgtgcgaattacattttagagcaggcagatatcgacagttttgatgtgtttatcagagccaatattgagaagagaatggcgaatgtatctgacagagttgatcttaagggagatgaactggttaagttcctccagaagagagaccacaagagaagagtatattatcgcttctatactaagagaaaatggggcgattaccacgattacaacatgatgttagatagtggagcaatcggcaaggagaattgtattaatttgattatcaaggcgattggtgaatagtggattataatatcgtaatgataatttaagggttggttctttgaaagtcagttttataagaagtcataattttcagggattctctaaattatttttagacaaagtatagccctctggaagataaataaagcatatttgtggcctcgagcaaaggctggatgccacaaatatgctttatttgctctcttctcgagtgtcagctagttaataaattatataggagacgaaaatgaagattacaagatgtaaatatgggcattattatgataaagcgtactttagagaatgtccgcattgctgcagggcaagaggtggcagggatgaggatattataataggaaagaacgagttatctacagatttatcagggaaaaatagcctgccgggtagaaacgtgagaataaatcaattacaagatgatagcaattacggacaaggctccaatagggacataagtcagaaggagcaggataggaaaaaagctgaacgatggattggggaagcctgggatgaactggaaaaggtagcaaaagagagtccaaaaacaaaagtaacagaaaaagcagctcaaagagaaaaacaagaagacaggcaagaaaagataacagaagaaaagaatactgtttcagtgaaaaagaagcatagaaattcggaacaaaatttagggaactatatgctttttgccgcaatgcctctcaaagtaattaaaaaccaggaattctgtatggatttttgtattttcccggaaaaagattgggagactggggcaaagatgcttagttttaagagtcaggaaagtataagagatttaaaaccagtgcagatggcgctgccaacaaaggctgtgctgcacattttatataaagaggaagagatttttcataaagatatagagttggaggcagaaagggaaaatgtattttgtacatttcctgttacggtaacggatacgagagaccgacgttttcatatgataaaggcggtttttgagatagaagagcaaaatatcgagattccgctgtatttaatgcctaatccgtagaaaaatacaggcagttttggaaaacattcgtggaactttattattgcagtttttgggaaatacctatataataaagtatcatgtaataattttgtaacaaattcaattcgtatggatttatagacacaggaatgagacataaataaaaataaaatatgaataaaacagggattgaatcgttacgataatttgaaaagataaaatatgattataaaggagaagtataatgagtgatatgacccatcttgatgagttagaggcagaagcgatatacattatgcgtgaagtagtggcagagtgtgagaagccggtaatgctgtattctatcggtaaagactcttctgtaatgcttcatttagcattgaaggctttttatcctgagaagccgccgtttccatttttacatgtaaatactacatggaagtttaaggaaatgattgagttcagagataagattgctgaaaaatacggacttgatatgattgagtacattaatgaggacggggttaagaagggaatcaatccatttgaccacggttcatcttatacagatattatgaagacacaggcattaaagcaggctcttgataaatatggttttactgctgcatttggcggtggaagacgtgatgaggagaaatccagagcaaaagagagaattttctctttccgtaattccagccatgcgtgggatcctaaaaatcagcgtccggagatgtggaagctttacaatacaaatattcatcagggcgaagaaatgcgtgtatttcctatttctaactggacggagaaagatatctggcagtacattcagcgtgaaaatattgatattgttccgctgtactttgcagcagagagaccatttgtcagaagaaatggcaatatcattatggtagatgatgaccgtatgagattagaaccaggagaaaagattgaacatggaaagattcgtttccgtactcttggatgttatccattaactggtggtattgagagtgatgcagatacacttgatgcaattattgatgagacattaagtgcggtatcttctgaacgtactagccgtgttattgacagtgatggcggagcagccagcatggaaaagagaaagagggagggttatttctaatatgaacagtcttcttaaatttattacctgtggtagtgtagatgatggaaagtccacattgatcggacatatgctttatgatgcaaagctgctttttgcagatcagaaaagagcgttagagcttgacagtaaggttggttctcgtggtggggcaattgactattctctccttcttgacggcctgatggctgagagagagcagggaatcacaattgacgtcgcttaccgctattttacaacagagaaccgttcttttatcgttgcagataccccaggtcatgaagaatatacaagaaacatggcagtaggagcatcctttgcggaacttgccgttatccttgtagatgcgacacagggcgttcttgtacagacaagacgacatacaagaatctgctcccttatgggtatcgagcattttgtatttgcaatcaataagatggatttaattaactatgatgccaatcgttttgaaaagattgaacgtgaaattaagatgatggcagcagagtacgactataagtctatcaagattcttcctgtttctgcgacagagggagataatgttacagtgaaatctactaagatgccgtggtataaaggagaatcacttctcacatatcttgaaaatatccagatacatgacgattctattgagagtggctttactatgcctgttcagagagtatgccgtccagatagaactttccgtggattccagggacagattgaatctggaaagattaaagttggtgatgagattaccgccttaccatctaatgaaaaggcagaggtaaaaggcattattgatgcaggtaaggaagtaacagaaagcagccgcggacacgcggtaacaatttctcttgacagagaagtagacgtttcaagaggctgtgttctcgttaataatgcaaaaccaaagaccggtaatttatttactgcaaagcttttatggatggatgacacacatcttgtagcaggaaagaattacctcttaaaacttggaacaaagctgattccagccgttgtcatgaatatcaagtacaagattgatgtaaatactggaaatgaagtacacgcagatgctatttacaagaatgaaatcgcagcctgtgatattgctgtttctgacaagattgtttttgagaagttcaaggacaaccatgcattaggttccatgattctcattgacagaatcacaaatatgacatctgcctgcggtgttatcatgcacgcattaagacgtacagataatctcacatggcatgagatggatattacaagagacttccgcgcacagcaaaaaggacagacacctaagacaatctggctgacaggactttccggttccggtaagtctacacttgcaaacgaattagaaaaacatcttgctgccctcggaaagcatacgatgcttttagatggggataatgtccgtatgggactgaataagaaccttggatttaaagaggcagaccgtattgaaaatatccgccgtatcgcagaagtagcgaagttaatgaacgatgcaggacttattgtaatcacatccttcatttctccatatgtccgtgacagacggaatgcaagagagattatcggagaggacagcttcatcgaagtttatgtaagtacaccggtggaagaatgtgaaaaacgagatgttaagggactttacaaaaaagcccgtgcaggcgagattccaaactttactggaatttccagtccatatgagacaccagaacatccggaagttacgattgatacaactggaaagagtcttgcagacagcgtagattatgtgatggcacagttggaagatttgcttaactaaaacaataaaatataagaggaaataaaaatgcgcacactttatgtacacattggaacgcctaaaactgcaacaacatccattcagatgttttgtgttgagaatcaaaaagtattaaataaacaaagttatagctatcctcttttggattttgtatatccccatgttgctcaccgcagaaatggacatttccttgtaggctgggtttataaaccgggtggtcaggaagacgtggaaaaagagcaggaactgtgggaaaagggatttgctatgattcaccgagaatttgaaaagtatgacaatgttatactttccgatgaaaatatctggcactcttctaacggaagaaagttccctttctgggccaaactcatgcaggatgcaaaagagcatgactatcaggttaaagttattgtttatataagaagacaggatggacttgcaaactcatggctcagccagcaggtaaaagaaggatggaataccaatgccacgattaagtgggattcgttccagcgtaaaacaagaaaagttgtttttaattattatcttttactggaaaagattgcagaagtgacaggacgggaaaatattattgtccgtatttttgacaggaaaaaattcaagggaaaggatcatacgatcttttccgactttttggaggcaataggcgtggattatacagatgattttaagataacagaagaagaagcaaaccgttctctgacaggaaacagtcaggagattcttcgtattgtaaatacggtacttccagatgatgacaaggtgagaacattagttagacaggccgcacaggactgcgaaaactataaagacccacagaataactttgtcatgttctcagaagaagaatttaataaatttatgggccgctatgaaaaatggaatgaggctatcgcgaaagattatttacatcaggaagaacctctttttgatatgaaaagaaaagagggagaaagatggactccagagaaccgctttatgtatgaagatatcgttcgtttctttggtggtgtagttatcagacagcagagatatatcgaagcacttcaaaaagatatcaatactctgaaagaaagccgtttagaagcggcaaaaggcttagaagatgcaaatgtggacgaagagacaaagaagattctccagtctctcagtgagcagattatcaatcagcaaaaagacattcagcgtgcccttgaaaactcagaaaaaattgatgcagtccgtgataaaaatcaggaagttaaagtacgaagccttactgttggcaatgaattaattgacctgcgccaggattatgatgcactgcagaaagagaccaagaaagacagcaaggcaatccgccaggaatctaaggaacgtgataaggagttaaaggctatgattcgtgaattagagcaaacatctttatggttccgacttcgtagaaaatggagacatataacagggaaggataaatagatttgccacaggcaaggaaacgccttctgtgagagataaatagacatctgtgtggataaacagacgaaaatagaagccccctataaccatatctgtgactttagtcactacaggttgaatgttcgcttgaacgctcgcatccaacctttgctccgaggtcacagatatggttatagggggcttctattttctgattttggctgactacagaatgattatttatcttccagagggctgtgctttggcagggagtgaaaatctatttatctttggagagatttgggggagtattgggaggttgcggctggctgtggagttggttttcgtcagtttagattaacctactttttcgtctgtaaaatcaacttaaaaaatatttcctatatttcctattgaaataatatgaaatatgatgtaatatagagaaaacgaataagacacatgaaaaccgaatgatatttaacaaatttttacattgcagttttttgaatatccctatataatgaaaggcaatatgataatatgagtgtaacagcagtacagatatcagaaagaagacaaaaagtaaaaacaacagtaagtgatgagagtataaagatgagaaagtttatttccatgactatgactatgttaaaaatcggtttcattggttttggtgggggaagcgcactgattccagtaattgaagatgaggtcgtagagaaggataagattgtatcagaagaagaatttaatgatgatgtaatgattgccagtataactccaggagcacttcctgtagaggttgctacaggaatcggaagacaggcttcaggattaaagggaatggcagcagcagcgacagcgatggcattaccgggtgctttactgacagtattattacaggcagttatttccagtgcaggaagtgtggtgaagtcacagattaattatctttctatcggaatctctgcgtttattattttaactttactggcttattcattaggaacagtatgccaggcagtgaataagagagaaggacaattgtatggtctgattattcttggagtgtttttactttcaggagagaaaagcatttatcagttattcgggcttgatattaaaccgatatttgcactgtcaacgattcaggtattaggagcggcattctttgtaatcttatttacaaaaggacatgtacgttgtttaagaagatccataccagcagcaataattacggtatgctatctgctttgtgccggcaatgcacatattataccagtttccgcgaaaccatttattctcgcagttatggcggtattatcaattcttggcctggtacagtctatcgtagaaagtccgcataaggaagcatttccagcaaaaagacttgcaacatctgcaggattttggctcttattcgtagtaatcctttctattccggcaatgttcctcacagcaaaggcattaaagtttatcggaatgggctgtttatcctctattatgtcttttggcggcggagatgcgtatctttctgtagcacagggattgttcgtggaaggtggagttatcaataacgcagatttttacggtaatgtagtagctgtagctaacgcacttccaggttctattttatgtaaaatacttaccggaattgcttatgatgtaggatataacttaaacggttctgtaatagaaggatttcttgtagcactttccggatttgcctgcagcgtggcagcatcaggagctatctttgaattagtattctgtgtctatgagaaatacgagagccttcagatattttccgtagtaaaacattttatccgcccgattatttccggactgctccttaccgtagcagtatctctgtatacatcaggaatccgcggtcaggtacagacaggaagtggacatccggcacttgtgattactcttattgtaattgcggtgaatcttgttttaatgtggctgcagagaagaggaaagaatatacatttgatttggaaaatcgttatttccgcaggaatctcctttgcgggatgtaatttattcctttaaaattttggttaagcttacagacgccgctgtaggagatgagcaatagattttcaatacacattattatgtatatgaattctgttttttccagcagcaaaagcacagcccacagtaaataaaagaaactatatttgtgacctcggagcaaggtttggatacgagcgtgtagaagcgagtattcaaaccgccgcgactaaagtcataaatatagtttcttttatttactgtgggcgtctattttgcctgcggcaaatcagaattcatattcatttggattagagtatatagcatctctgtccaattcttttaggattgcagcccgtcgattgccgactaacaaggttttattatatttgaagtaccgttcgcatccattttccgtaataaactgtgatgcctccggatccattgtaagttccgtgacaaatacaaccatttcctggccttcatcgaaggcttcttccatgaaagtgaaagcattttccagcgcggaggatgctttttttattgtatctatgcgggtttggcattgtttatcaaatccagatttggcagcgaggaaggcttcttttggtggaaggctggagtctggtgtccaggcagtaaggagttccaataattttaattggaagtttttctgttctggagaggtgagacctgctttattttcctgttcatattctgctgcttttttctgtagaaggacgcggtagagtccattttcagttgggatactggatttaggatcaggtgtaccacaatctaaatgagccgtattagaagtagcagctatattgccatttgagtgattcacttttgagacagtgtcagatatatccgagcctggagctgcagaatctgaatcggaagaattttgaatctgttttttcaattcaatctgataagtttttaagaaggcataggcttctgttgtcagattatcggcagttagagcatcggagatatagttatgcagcccgctgatgaggagttcgacacagcttaaatgttcgtcaaaagaagcgcggaacagtttggcatagatgtcggctccggcctgtcctgtgaggatgcggctgatatcgtagtcgtctctgtatttttggtagagatcatagtaggcggcaacgtcttttgcaatgtccgcgtgctgaatgaactggtggatgatgtcttcgtctactttgatagaaagctcttcgtaagtgtagataaggctgcttaaatcttcccatcctctggcggttacgaactgaatgccatccacatcattttctgtacggtaaaagttctgcgggcggagttctaaatagcttaaaatgaatgggtgcaaatgtcgtgctctggcgtagcctttgaaaacgtcaaggtctgcttcaatatcaattttgcgtacacggtctaaggttacgaagtcaaagtcgtggacgcttcggttgtattctggtgggttgcctgcggcaacgataatccatccttctgggacagcctgatttccgaaagttttgcactgtaaaaattgcagcattgttggagcaagtgtttcagaaacacagttaatttcgtcgataaaaagaataccttcttttttgccggactcttccatgtactgatagatgctgtaaatgatttcactcattgtatattcggtgacggagtaagatttgccatcaaatgttttttctttaataaatggcagtccgacagcactttgtctggtgtggtgagtgatggtatatgccacaaggccgatgttacattcctgtgcaatttgctgcataatctgtgttttgccgattccgggaggccccattaataacatgggacgctggcggatagagggaatactgtactgtccgtaatcatttttcttcagataagcccgaacggtatttttaatatcttcttttgctttttttatattcataagattgaatcctttcgttgttgatagatttatagaataccaaatataataacaggtaatttttggtcatattcataaagttgaataaatatttaaagatcttcctcgtgcaatatcaatttcatcgcccatgctggcacatcaggatgttcttcttctcctaagaacaaaaaggcagtttcataaggtggcctttttgcgggataaatgccttttccatctgtaaagtacagaacacccttcaaattttgaaattctccatcttcaagtaatttattaatgtaagaaaaggcaggacggaaatcggtacccccgccaccgattaattcaaagttatggagcagttttggaatgtctctctgttccttaataatggtatctgagtgtacctgattgtcacattgaataattcgaatctggcttttatggaaaaagctgtcccgctcctgaataatctgaaatgtttcttcaaggaatttctggacaagtgggccattggtcgaatagcttgtgtcaatgacaatgacaaactcagaaatcttagttacttcccggctttctaatggttcaatcagcggcatatttttataaagccgcagaccataagagtaataatttaagtcaaattcatcatagtcacagtgaagttcttccttaagtacggtgaattttcgaaggaagtctttataggaacggcggctttttccctctttgatctgcgttttcatagcatcaatgccggaggcggaatcatcgccacgaagatttaattcctgttccatgcggcggctgattttatcccatgattgtcctgcctttgcggcggaaggcgaagttgacggtttttttggccagaaacggtgatcatcggtaaaaaactccatcataagttgatttaatcggtctggattgtcagcgatatcgggtaaaagatacctgtaaatatttgcggccgtgatgggaattttatattgacgaaaatcgttataaatatttgtgcgtattccagagagagcacgctttacgcttttcttctcaaaagaatcaataatccactctacagcaatgtcgcaggaaaggttccacaaatctggatcgcggcttccacgaatccacagatgccgaaaaatacagtgaaatacgctgtgcagtacagcgcgatttaagaaaagcgggttggagcggaatacccgaagaatctgttctggcgggaaaaagaaggagattccatcagttgctgtcgaacgaagagaatcatttggtgttaaggtaagtgcggaaacggcaacatcaagataacgaaaatccacatatagttcattttgaataagttcgagaattttaatacacatttcattttcccattcagtttgtgtcattgtatcacctcctaaaaatccaggtcaaaatcaaatgtttttttagaaaaagacttatgttttgcttctattaaaaaagcatttccctctccccattctttttctatgcactggtcgatggcagaagcgagagcggatgcatcgggagaaaaatgctcgcagataaattgaagcatcggaaagtcctgatcttttacggcaagggtaaaagcagtgcccatatatttttttatgacattttcatatttttctctaaaaatgtcttccagccgagaaggccagcgaaggcggtttaaagcaattttacataaagactccggcgattcgaccgtaagagcattttcaaggcaggaatcatactttctgtaattgagaataccgttttcaaagctctttctcatgcggaagccttcaccatgaatacttctgctaaaaatatgagccggggaaatctcgtctaaccattcataatattcagggaagaacacaatactttctggtgatgaggaggaattcggacagaaagaaacggtaatattttctgcgattcgctccaaaataagaggtaaaccggttgcttcagaatcttttccacgaatgatcagatgctccagctgggaatcattcataaattcatcgcttccaatgccggaaattgcagttcctacagaaagtttttttaatttacggcagttataaaatgcggcattgtgaagtgttgttgcacagtcaggaagagtgatttcttcaagaaaggtaccatcaagctctgttccaaaagctgaaaaatcaaaatctttctggttaaaagcctgtccgctttccagtgtagtttcctgattttctatatctataaaaatagttttgtaaattttctcaggaaatctggggcgagaacgggaaaaacagtaagctcccatttcactgactgtccgtccgtcaatcatatctggaacattcaatatgggactgttgccaaaacagcgaagcagccggcagcccgaatcggcaggttcccagagaatagtcatagtatctgtaacaaaatgagaaaaagcattatttgtaaatgttttttcggccgtactatcggatattttagtaacagatagttcattgcctgatgttttgttttcagatatttcctcaattgataaatttgtattttttgtaaaatccatagtcaaaatcctattgtaataaatttgtagttctagagtgtttgaaaaatcattcctgcataaagacgcattgtgtgattgtagtcagcccgttgttttacgcaaacgatatgagaaaagaaacaaggctgtacagtttacaattcattttttgtttcctttagcatcatatcacaaaaacaggaaaaaagagtgagagataacaaaaaatatggtaaactatctgcaaataaagttctgagagattttatttcttggaataaagaagccatagacaatacattttcataattttattttgatattatgaaagatatgtatatctaaaatcatagaattgacagacaggaggacaacatgaaaacattaggatttattggaatggggaacatggcaggagcaatagcagcaggaatattacaaaaaggtttaatgaaaaaagaagaagtatttgcctacgcaccgcattatgaaaagcttgaggcaaatgcagaaaaaattggttttgttccatgcaaggatttaaaaggattaacagcaaaagcagatactttagtgatggcttgtaaaccatatcagatagaaggagttctttctgagattaaggaagagttaaaaggaaaggcattaatttctatcgcggcaggctggaattatgacaagtatgagaaatatcttgataaaagtacaagacttcagtttatcatgccaaatacaccggcaatggtaggagagggtgttcttttatttgaagagaaaaattcacttttaccagaagaaagagaagaaattaaaaagttatttgaagcattgggaattgtaattgagctgccagttcatttgatgggaatcggtggagcacttacaggctgtggccctgcttttgtagatttgataattgaagcgttaggagacgccggggtaaaatatggagtacctagaaagcaggcgtatgaaatggtatctcagatgatacttggaagtgccaaattgcagcttgagaccggcgagcatccaggtgtgttaaaggataatgtatgttcaccggcaggaacaacaatctgtggtgtggatgcattagagcatgcgggaatcagggctggatttattgatgcgattgatgcaattatgaataagtagtattttataaataaaaaaccccacgaaaaattccgtgggggttatatttactatatataatcggttttgaaatatttaatctaaattatgtatgaaatcttaaagtcccttaattcggatgatataagaaacagttttagaatttaaatatccctgagttttctttccgatattgttaaagcggcttcctgagtggtgaccatatgtggcagctttaccagcgtcaaaccataagcgttcaccagaagaattcttaccagcgtaaatgtttgtgtgtccaagtccggaccagagaacaacgtcacccttctttaagtttacgcgggaagcacgtttattaactctgataacctgtacttttttctttttccagtgtccgaagttttttctgatagaagaacttccacggcggatgtagaatgtctggcctgaacctaatgcgccgtatttctgtaagcaccaggaaacatataatgcacagttagaacgtctgcttcttttaactgcagagttgtaagttcttgctgttccgccattgctgtaaacgaaatgtttcttttcgatattgtcagccatggaactgcaaatgctcatccagcgagccatcttagcggattctgctttactggcatgaacctgtgcaggcttagccatacagaagcttaatattaataaaattgcgaataaactagtaaataattttgattttaaatatttcaaacgatatctcctttttaataaattgcgtgtttttcgatttgcacaagacctatattaatataattattaagaaatgtcaagataaagttaacaattttgtaacacttatagcgaaatgatgttaaaaaccttaataattaagactaagctagtaacaacatggaagtttatggtatgataaaaacaggaggaaaatgacatgaaatacgggaaatttttaccagaaaatggtacaataggatttgttgcgccatcatttggatgtaacatagaaccttataaaagtgcatttgagaacgcacagaaagtatggacaaaagaggggtattctttgagtcttggccctaatgtttatgaaggatgcggcataggaatcagtaatacgccggaaaaatgcgcccaagaattcaatgagtggtatgaaaaagaagatgtagatgttcttatttcctgtggtggcggagaattgatgtgcgaaattctcccatatgtagactttgaaaagattcgacaggaagagccaaaatggtttatgggttattcagataacacaaatctcctttttttattggcaactctttgtgataccgcaggcatttatggcccgtgtgcagcagcttttggcatggaaccgtggcatgaatcgttaaaaaattcgatggaaatattaacaggaatgtgtaaaaaagtacacaattatgacaaatgggaaagggaaggtttaaagacagaagagaatccattagtaccatataatgtgacggaaaaatttgagcttcgtacctggacggcggaggatgggctttctacaggaaaagaaccagaagaaattcagagtgtatcagattgtaataaaatatcttgtgataaggtatcggcaggtgaacctcataaaattataaatgaaagggaagaaattgctgtaaaagggcggcttttaggaggctgtcttgattgccttgctactttatgtggtacaaagttcgataaagtagaagaatttaatgaaaagtataaggaagatggtgtgctctggttcttagaagcttgtgatcttaatgtaatgggaattcgcagggcattatggcagcttgatgagtcaggatggtttaaaaatacaaaaggctttttgattggacgaccatactgttatggagaagaattcttcggtttagatcagtacaaagcagttattgatattttatcaaaatataacgtaccgataattatggatctggatatcggacatttaccaccaatgatgccgctggtatgtggaagcgtggctgaagcgaaggtaaaagataattcgataacaatagatatggagtataagtaaggctttgtcctcttctggcaagcggccggacctgttctgtttgtggttacaaaaatgcaaaaacgaaaaatcttgcgttaagagagtgggattgtccgcagtgcgggacccatcgaaaactaaacttgccgaggtgggggaggatgtcacaattaagacaagagaaataaggaaaggatttatttatgaaattaatatcttggaacgtaaatggacttcgtgcctgcgtaaaaaaaggatttgaagactttttcaaagaggcggatgcagacattttctgtgtacaggaaacaaagcttcaagaagggcagattgactttgcaccagaagggtatgaatgttactggaactatgcagagaaaaaaggttactctggcacagccgtatttacgaagaaacacccattaaaagtgtggaatggaattggaatggaagaacatgatcaggaaggcagagttatcacattagaatttgaagatttcttctttgtaactgtatacacaccaaattctcagtcggaattgaagcgtttagactatcgcatgaaatgggaagatgatttcagagaatatttacaggaacttgataaagaaaaaccagtcattatgacgggtgaccttaatgtggcacatgaagaaattgaccttaaaaatccaaaaacaaataaaaagaatgccggatttacacaggaagagaggaataaatttacagaactcttaggtgcgggatttgttgatagtttccgttatcttaacccagaacttgcaggagcttatacatggtggtcttatcgcttcaaagcaagagaaaaagatgctggatggcgtattgattactttgtagtatccgaacgatggaaagaaaagatagaagatgccattatatataagacggtcatgggttctgaccactgtccgataggattgcagatgaaataataatttgcagcaggcaaggttgatgctcacccccatgtgagaagatatcttctcgcatggggagctgtctttggctggagagagttattatttaaattgttataatggactgaaaggaaaagattatggaaaagatattaataatagtagatatgcaaaaagacttcgtggatggttctcttgggacaaaagaagcacaggcgattgttccagcggtgaaagagaaaattgagaattttaatggagatattatctttacaaaggatacacatggggaagattatatgaatacacaggaagggcagaatcttccgattcctcattgtattaaaggaacaccagggcatgagattataaatgaacttcagccatatgtaaaaaaagcacttgctgtttttgaaaaggaaacgtttggttctcgtaagctggcgaatttcttaaaagaacttcataaagaaaaagagatagagtctatagaacttattggattatgcacagatatttgcgttgtgtctaatgcattacttataaaagcatttttgccggaagtaccgattttggcagatagtaactgttgtgcgggagtaacaccggagaagcatgaaagtgcgttggaaacaatgaggtcttgccaaattctggtttgtgaggctgcaaagcagacgaactcctgaagctaaataaagcatatttgtgactttagtcgcagcggtttggatgttcgcttaaagcgctcgcatccaaaccttgctccgaggccacaaatatgctttatttagaatattttgtgattaaatccattatgataggaatcgctctattaagcttactttctttcaatgtttggatatattcctcacgttcatcataaacatactgtacagccttcaacaaagtattgcttgtaagctcctcttcctgcagtacatagctatagccagatttttcgaaagaagcagcatttaaaagctgatctccacggctctgggaagctggaagtggaataaggatgtttggtttcttgagggcgaggagttcgcagattgcgttagctccggctcttgaaatgattaagtctgttgctgcaaataaatgagttaattctttctttgcgtattcaaactgtttataaccattttttccatcaagggaagtgtcataatgaccacgtccacataaatggataatctggaactgctttaacagttcatctaagttctctcggatggcgttgttaatagcaacagcaccaagacttccgcccattacgagaagaactggtttggaatcatcgaatccacaaagacgaagaccctcttcctttttgccggagaaaagttcctgacgaattggggaaccagttaaaacagccttattttctggaaggtgcttcaatgtctccggaaagttacagcagacctttgttgctgctggaatacagatcttattagcgagacctggtgtaagatcagattcatgaataataactggtacacgtcttctctttgctgcaagaacaacgggaacggatacaaagccgcccttggagaatacaatgtctggttttaacttccgaatcatgtgggaagcttcaagataacccttcataactttaaatggatcagaaaagttcttagggtcaaagtaacggcgaagcttaccagaggaaattccgtgataaggaatacccatttcttcaatcaatctcttttcaataccgttataagaaccaatgtattgaatatcatatccggcttcttttaagcttggaaccagtgccatatttggcgtaacatgaccggctgttccaccgccggttaaaacgattcgtttcatacttttaaaaccctcctgaggtaagtgtgtgaacatccttatagtaaatatagattatgcctgctgttctttatatgctataagggcaagtgcaagctggtcaggacaggaagtacctctgccgccacagtcaataccctttatcgtattgattacttcatcaatattacgtcccttagcaagggctgcaacgccctgagtattacccatgcatccgccaataaaacggacttctttaataatatcattttctacatcaaactgaatttcacgagaacaaactccctttgttttataactgtacatcgattttcctccgctatgtaaaaatacttttccaaaattgtaatgacagtatatcacctttttatctaaaaaaatagagaaaaaatgcctaatttgaggggcctgataaaacggacaaacggacaaaatgcaaaaaacacgctctagagcaaactcttaatgcgattgagcattaagagtgtagtgatacgaagcatttttgtataataatcctgcttcggtttcgtctcccctttgacaaattcctaatgacgtgaggggtcatctgtgttataatgagtctacttgttttgatgacagttaaaaatagaacattaagtattagaatagtacatggaggaagaagatatggtttgtattggtgtaattggagcaatggaagaagaagttgcttctctcattaaccagatggaagatgctgagtctaagactatggcaggcatgactttcaacaagggaaagttatggaatcaggatgccgttgttgttcagagtggtatcggtaaagtaaacatggcaatctgtacacagattcttgtaaatatttacggtgtagatatgttgatcaacacaggtgttgcaggcggtctttacaaagatattaatgttggtgacattgttatttccagcgatgcactgcagcatgactttgatgtaacaggtcttggctataagaagagtgttattccgggaatggagacatccgtatttacagcagacacagaattagtggagatggctaaggaagcatgtgagattgtcaatccagagattcagtgttttgttggaagagttgtaacaggagaccagttcatttctgataatggcacaaaggctgctctcgtaaaagattacgatggatattgtgcagagatggaaggtgcatctatggcacaggttgcaacactcaataagattccatttgttattattcgtgcgatttcagataaggcggataacagcgcaccagttgcatacgagacttttgaggaacaggctattgtgcatacagtgaaattactggctgcaatgtttcttaagatgtctaaatagatgtccaattaagtcattttcataaagaagtattcgaatcccttttccttttgacggagaagggattttttttacgaacgaatcccccttttcaaatggattttcatttcgtataattgggtcacaatccagacagagcaaaataatttcgcatggcagaaacagaatgtgggtgagtcatggcagacaagatacccgattcgcagatgcttccggctggggcccatgccgagaagaaatccgtacataaatctgaccggaaaaaagagtctgcgctggactgtattacctgataatattaaacttctcgcggttaaaataattaagaaggcgagattcatggtaatttattatagctaaaattatgaatgtgaaaatgtttgaaatacctgggagggaagaaaatgtttgattttattcttggtaataccgtttttacaaaagcaattatagcctgttgttttattggaatactgagctggtcggtgttgacgatctcatacagaagcatgatacgtgcaacgtcgaggatagggcagacaaagaaaaagtggcttgtttctctgaaaaagaagtacgaagattatcacgaaatggatatcaaagtgaataacgtggaaacatttgtggataaatatttccgcaagaaaagagtttgtggattaccttgtggcttttggaaaacactgtatcgcctcacaatagcagcatgtgcgataacaggagcggcaggagcgctggctgtctcacaggaaggaggtgaactgaccagtgtaattgtcacctatctgaccggtgtaatcgctgcatttggattgatattccttgatattttgcttcgtgcagatgcaaaagaacatcgcatcatcatgaatatgaatgattacctgcaaaatgtattagagaacagcatagcaggacgtgaagtagatttagaagatggtacttcaagagagcagcgccgccgccttcttcgttatgccagagagaacacgaagaagaaagcgaaagacgagccggtatctttagaagaaaagaaagtgctagaggatgttttgcaggagttctttgcttaaaaattttatgcacatagttcaagaatgccccggcattcttgctgcgagatgcacgttatgcaattcacatctgatatagtcaaatatatagatgcagatatatgtgtcgcatagatataattgaatatagctatatgctttgcatagatatagttggatatatagatataaggtctgatctggaaatgggaattaggatgaaaaatgaatcaccccttcttcagatcggacaaagagtggaatgtatacccctctttctcaaggtttgtgagaaccgtatctaaagcttcagcgtttgatttagatatattatgtatcagtggaatggcgccgggatggatgtatttttcaaaatgattgataacgtaatcacttcccggctgattatcaacatcataatcaagataagccatactccaaaagacagtggtatagccgatatcctttgtaatctgaagggtgcgttcgctgtattctcctttcggcggccggaaaaaacgatccatttcgtatccggtcgcttctttcatgtaatttgcattatctgtaatttcttcacgaacttttctcgaatccgtttctggcatacaaacatgatgggaagtatgattcccaacgatatgcccttcttttttcattcttttgaccagttcaggctgatcctcaatataatggcggcacaggaagaaagccccgggtgctttatgcttctttaacacatcaagaatagatgcggtatagccgttctcatatccacagtcaaaagtaagaaagacaggtttttcatcaccctttagatttgtttttatataccaggcatcataacgggaaagatctacttcctcctgtgcagaaggggtcatatgattttcttctcgtttaatccaccatgccatttttttattaggaagcgtatcgggattaatagaagaaacagatttatttggctgcgtggaagcagcagcttccttttggacggattccatagaggaacgggtggaagaagactgttttgaagaaaaattgttttgagaatttggatttttattatgggcaaaaggatgacagccacaaattatgaaacaaggaaaaatataaagaaaaagaagaaattttttcataaaaagctcccggaaagaaaatctttttataatatatttcttcaaaaaataaatatgaatatttaatcagctgataaatatttcaattccgatggcaatcaggatgattccaccgagaatctgcgctttgttggataattttgttccaaatttttttccgataattaatccaccaatgcagataaaaaaggtaacgatagcaatgatcagggaagcagcaagagccatgatccagttatattctgcgatagtaaaaccaacagataacgcatcgatagaagtggcaattccctgaacaaacagtgcccctggactgacggcagatacttcttcttcgcagtcattttttataccttcaatcagcatttttccgccaataaaaagaagaagaatcaatgcaatccatggaataaacttttcaaatacatgaaaagactccgcgatcgtgtgtacgcagaaccagccaatcagaggcataagtgcctgaaatccaccaaatactccggcaattgtgcatacacgccctttgttcatatgtggttcattcagaccgtttgccatggaaacagaaaaagcatccattgccaggccaattccaagaaaaatgttcgtagtaaaaaatagtaagctccaagtcattagaaatccctcctgattgtaatatgtactccacaaaaaaattctgagagtacattaatcataataacgcaaaaaaatgagcatagcgataagctatgctcaggtaattatcataaaaatataaaaagacccctgtatagcttatcacagttatacatgagtctcgcaatttaaaacaagccaggtgaattacaccagtatgttgacttgctacgttccaacgtataaaagaacgctcgctactccctcacggaataatgtctgggtggaagtatagcatataggggagaaattatcaataactttttctcaacaagtataacaatatttaggaaattacatttaccagtatttgaaaatttcttaatcctcctcaataacctgaaaatcaagataatcaaaatcaatgtgttcaataaagttatcctgataaaaacgagtccttgcatgactaataaactcccgtttatttttatcaagccacatcggtttttcaaggtcaaactcataacaggcacgttctaaacaatcatatactttggcagtacgggacatggacatatcatagttctccataactgtgtctttaagcatatgatttttttcaaaaagtttgcaccagattctcataaaagctcccttctgatatatttaatcgtagatattgtaaatcatgtatgttcagaatctcaatagtagaaccgattatactggtgttagaatcttaatataaacggattcagtggcagatattctgaaactacatataatgtatatgtagaaatcggtatttctgaaagtgtaacgaattcagaagcatttgtcaattttctaataaagtaaggggcattcttgaatttgcctttattcagttgacgtagtccaagtccgctatgcagcccccattcaggaaaaatctcccgcaaattgtaacgaacatcttacggaaagcatttttcaaatacgcttccaggtaaaatattcaaaaaaattcgtgaaagtagtcaattcgtgaaagtttataaaggaaaaattgcaaaaaagtgccgatattaaaaaaatactgttaacaattcgtcaaagtgtgttataatccgtaaatataacgcagtaacgcgataaacatttatttttaataaataatgcaaggaggatatgcaaaaatgggaagagtatataatttctcagcaggaccggctgtattgccggaagaggtattaaaagaagcagcagatgaaatgttggattataaaggctgcggaatgtccgttatggagatgagccaccgttccaaagtatttgatgacattatcaaagaagcagaacaggacttaagagatctcatgaacattcctgacaactataaagttttatttttacagggcggagcttcacagcagttctcagcaattcctatgaaccttatgaaaaatggtgttgcagattacatcgttacaggtcagtgggctaagaaggcatatcaggaagcaagccgttacggaaaagcagtaaagattgcatcttccgaagataaaacattctcttacattccagactgctccgatcttccaattgatgaagacgcagattatgtttacatttgtgagaacaacacaatttacggaacaaaatataaaaagttacctaacacaaagggtaaaacattagttgctgacgtatcctcctgtttcttgtccgaaccacatgacgtagaaaaatatggcgtaatctacggtggagtacagaaaaatgtaggaccagctggtgttgtaatcgtaatcatccgcgaagacttaatccgcgatgacgtaatggaaggaacacctaccatgcttaaatacaagacacaggcagacaaagattccctctacaacacaccaccatgctacggcatttacatttgtggtaaagtattcaaatggctgaaaaaacagggtggacttcaggcaatgaaagaatacaacgaaaagaaagcaaaaattctttatgatttcttagacgaaagcgaaatgttcaaaggaactgtagtaaaagaagaccgttccctcatgaatgtacctttcgtaacaggcgataaagaattagacgctaaatttgtagcagaagcagaagcaaacggttttgtaaaccttaaaggacacagaacagttggtggtatgcgtgcatctatttataatgcaatgccaatcgaaggtgttgaaaaattagtagaattcatgaagaaattcgaagcagagaataaatagaatttgctgtaggcgtctaccttgcctgcggcaaatcactattcagtatccctttgcagatgtattcggctaatttatccaccagataaaggctcgtatatggaagcagaatttcacttgaaacagaagcctcatttataattccagtaatagaaatatcgcctacagggcacaaaggccgtgcaactcctttccctggggaaaggggctggcgggacagggaaacaagaccaatatgattcttggttccaacagcggcatcaatggcaagggtacaagcatcgggatggactaaagaaatttcagggagctgttcggtcagattgccggcatggagaggtttttctaaagttccatacaaaggataaggaaatttccgttgttttaattttgagccaacaagagggccgaggcagtcaccagttattttgtctgtgccgatgcaaagtagaacaagatcttcgaattttttatttaaataagtaatatggttattaagtgcaatggaaaaaggtatagtagaagcgttgtcaggggcaaaatactgatagcgcttttctttttttatgttgaaattcatgttaaaatcctctctttgttctcagagtctttcttgcacttgcttttgtggctgattttccgccagccgcacccagatttcatcaacgtacgcaccgcgtacgcctcaaaaaatttgggcacaattgacaaaaaatttctcacaaaatcaagcacaaaaagattccgagagtacatatttttcctattttatgatctttatggagcaaaatatttgtatttatatacatcatctttttgtattcctttatagaattcctgccttctaattgttctctatattttagaagtagacaaagagaaagaagtttaaacaatattttattttacatagaacatttacttgaaaaatgaaagaaaaatgcgaaagcatatgacaagaactgccatagacaagaattgggaaatgctatgattgagacagcctgaaaagaaaatataaaataaatcaggaaactgcagctttaagcatagggcaaagagcggagttagaaatagaacagggaaggtgggagatttatggcagaggaaagacaggaaacgggaaagaaaaaaggaaatgaaaaaggagaagtatcaagaaatcttcctagaaattacaggcagattggagagccgggagcaaagaaaatttatgtggaagattatgtgtatacatatttaaataaattggcgcagccagaaaatctttatgcaagaggtgctattttatttgggaaaatgtataaaactacgataggaaagtgtatgttcataagtggagcagcggcatgccagaatttcgaactggatttagatgagacgattttttcagaggaaaactggggagagatttatagaataagagattccttttttccggagctggagatttgtggatggtttttgtcaagaatggggttttctgttgatttaaatgacaaaattatacgaattcacatggataactttagcggagaaaataaagtgttatatatgattgatgcccttgaaaatgaggatgcattttatcaatttgaaaattattcccttaaaaaacagcgaggatattacatttattatgaaacaaatcaggaaatgaaaaattatatgttagcagagggtgagatggggcgaatgccggaacggggaaggcgttcggaaacaataaagagggatactgctgttgtgaaaaattataaaaaggcgctaagaaaaaagaaaagtttgcggccgaaatcggcatttgctaacccagcgtatgttgcgggcggtcttgtagcagcgatggttcttatttatggagtaaggtctgcggtacagtatcagggaaatcagaaaatgcaggaggtatttcaacagcaggaaatgacggatgcgaaaaatgtgacaggtgcacagcagggagaggaggaaacagataccgtgtctaagatagaaacgacacagaacagtgaaaatgaagtggtttctgatgaaaaagcgggttcttccgaaatatcagaagaaagtaacagtgaatctgccgtgcaggataccgaagcaagtgaaacgcaaaccacggaaaaaacacagcaaacctgggggagcataggaggatactataccgtaaaaagaggagatacattagctggaatttcaaagaaaatgtatcagtcatataactatatagaaatgattgcagaagcgaatggaatagataatgtagatgagatatatccaggtcaaattttagaaatccctcagattgaagattaaaaaggttcatgctataatgagcggagtgacataaatgtcatataatatgcatacgacatctatgtcatatagtatacatacgtcataaaatattttatagaaagagaaatgaatggcaaaacagatatataattacgaattgtttacaaataagaaagatgaactggcaaagataagaaagaaagctgcaagaaatcgaaggataaagatattgctgctggcgttgatcttagcgggaacagcgatagtcgcttatattctttttaatagcaaatgcaactattatacatataaagataaagttgatacagaggacagcggtgatgtatcttacgaaaactttgatgaaggatatctgaaatatagcagcaacggtattgaatatcaaaagcagtttggaagagcagaatggaatattgcattatcctatgagcatccatttctggcgaagtcagattcttatgcagtattaggagataaaggcgagaatacgcttatattactcaataaaaatggaaaagtgagagaattcacattgaaatatccgttgttacaggcaaccgtttctgagcagggtattatacagatgatacttgaaggctctgacagcaattatgtacaagtatatggaaaaaacgggaagttgattgcggacatgcgctcatctatagaggaaaaaggttatccgattacagcagcgatttctccgaatggaacacagcttgcggtaagctattattctatcaatggaaatacttccaaaacatctattgcattttacgatctcagcagacagctccaatcggatagcataccattaaaaggcggatttgattatacaaatacgattattcctaaagttagctttatggatgataatacggtagcggcattcggaagcaaagtaacatatttttataatatagaggattctccaaatgagaagaaaaaactggagtttgatcagcaaatacagagtgtatttgaaaatgaggattatgtaggctatattatcaataattctgccaatccggaaaaaggtaagtatattcttcaggtttataataaaaaaggtgccagaaagttaaatcatatcgtcgatatgaattatgattccatatctatgtggggtaaagaaatcattgcagtacgaggcaatgaatgtacaatatttaatataaagggaaatattttattccagggtgaactagaaggcgattctatagaaacaattgtaccagcaaaaggctggagaacttatcatgtagtatttcgtgataaaatagtgaaaatgcagcttcagttctggaaaaacggtaaataggattttccgcaggaaagggagacgctctctttgggcgcgtctccctttcctgcggaaaattattttaaaaaaatgaaaaaaacccttgacgaggatgcaactctatgataagatagcatacatcgcacatgagagcacattaatttgaaagaaagatgaaagaattctttcagaaaaatgaaaaaactcttgacaaaataaaagatgtgtgatacgatataaaagttgcacgacttaaaagaacgagatgcctaacctaatgagttgagcgcaaaaaactttcaaaaagaagttgaaaattatttaaaaaagttcttgacaaacaaaagtcgatgtgataaaatataaaagctttcgcacgaaagcaaaaccttgataactgaataacaaaacaaccttgaacgttaattcgaatttcattcgggttttcctgagagtgatgtctgcgggaaagtccatggaacagaacgaaagttcaaaacctaaataaacagtaatgacaggaaaagaaccagtggttctggaccttgatctgacatcttaaacattttatttgagagtttgatcctggctcaggatgaacgctggcggcgtgcctaacacatgcaagtcgaacgaagcaccttacctgattcttcggatgaaggtctggtgactgagtggcggacgggtgagtaacgcgtgggtaacctgccctgtacaggggataacagctggaaacggctgctaataccgcataagcgcacgaggagacatctccttgtgtgaaaaactccggtggtacaggatgggcccgcgtctgattagctggttggcagggtaacggcctaccaaggcaacgattagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggcttcggtgccgccgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctcctttctaaggaagacaagtagagagttgttttgttattcagttatcaagcaaaaacttgataagatatttccggtggcgatgcgctcaggggacacacccgttcccatcccgaacacgatggttaagacctgagcggccgatggtactatgctggagacggcatgggagaacaggtggctgccggattcccttgggggattagctcagttgggagagcgcctgccttgcaagcaggaggtcacgagttcgaatctcgtattctccactgagggctcatagctcagctggttagagcgcacgcctgataagcgtgaggtcggtggttcgagtccacttgagcccatagggtaaaaggataactttcaatatgaaggaaaagtcacttgagcccatagataaccatgattgaatggttatcacaattcgtaccttgaaaactgcacacagaaagtttttcttaaagaaaagcgacatcagatttctatgataagaaagaattgagactaaatcaattctcccaatagcaagtcgaaagacagaacatgagttttaactcatacgccgaatgttctctacgctaggaggaacaggaggcagccatttcttaggaaatggacatacaaaggtcaagcgaagaagggcgcagggcggatgccttggcactgagagccgatgaaagacgtgataagctgcgataagcttcggggaggagcaaatatcctttgatccggagatctctgaatggggaaacccggctgtatggactacagtcatccataagtgaatccatagcttatggaagggaacccggggaactgaaacatctaagtacccggaggaagagaaagaaacattcgattccgtaagtagcggcgagcgaacgcggaagagcccaaaccgtgatgcgtgcatcgcggggttcggactgcataagggattcagtaacggcaggagaacggctttggaacagccggccagagagggtgagagccccgtatccgaagccagagctgacccggcaggatccagagtaccacgggacacgggaaaccctgtgggaacgagcggagaccactccgtaaggctaaatactactcagtgaccgatagcgtatagtactgtgaaggaaaggtgaaaagaaccccgggaggggagtgaaagagaacctgaaaccctgtgtctacaagctgtggaagtacttcttaggtacgaccgcgtactttttgtagaacggtccggcgagctgcgggtactggcaaggttaagcacttcaggtgcggagccgtagggaaaccaagtcttaagagggcgttttagtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaacccgtaagggttggtagaggagcattcttaggggagcgaagcattaccggaaggggatgtggaccgctaagaagagagaatgccggaatgagtagcgagagcaaggtgggaatccttgcggccgaatatccaaggtttccagagtaaagctgatctgctctgggtaagtcggggcctaaggagaggcagagatgcgtatccgatggacagcaggtttaagattcctgcaccccttgttatcagaactgcggggacacgggaagggaagcagagccgggaatggaaagcccggtgcaagcgaaggagtcgcagggttggaaaatccgccctgcatgagacgaaggcgtgatgcggagcgaaatgaagtagtgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccgaaaggtgaggtatatgggctgacgcctgcccggtgctggaaggttaaggggagagcttagcgcaagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctaagaactcatggcgccagccgtgagggagccgatgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataaagtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagcccccctcaagatgagatatccatactcgaaagagtgagagaccccttaaagacgatgaggtagatagggcagagatggaagcacagcgatgtgtggagttgactgttactaatcggtcgaaagcttgaccttaaaaagtacttgcaaagttcaaagagatatgatataatgtgtgtggttttcagggtatgacacctgacaatattcctcgatagctcagtcggtagagcacgcggctgttaaccgcgctgtcgtaggttcaagtcctactcggggagtctggctccttggtcaagtggttaagacaccgccctttcacggcggtaacatgggttcaaatcccgtaggagtcacttgtggcgtcgtagccaagtggtaaggcagaggtctgcaacaccttcatcaccagttcaaatctggtcgacgcctcttaaaagagactaagtgattagtctctttttagtatttctttttaatttaatatcgcggggtagagcagtctggtagctcgtcgggctcataacccggaggtcgttggttcaaatccttcccccgcaatttgaggaacatcggtacattggtatcggtgtttttttatttgtttaaactgacgcaatagtaaaacccgctataagtctatctgtgactttagtcgcggcgtgttgaatgttcgcttagacgctcgtatccaacacttgctccgaggccacagatagacttatagcgagctttactattgctggctttgaaggaaacaaagtaaaaattcttagatgtgcaacgattcgatgttggggagagtgtgtgaatttaaaatatagattttttggtattgattttgttaatataattacaatgataaaaacaaattgcaatacaaaatatacataatttcatctacagctatccgggcaattttcaaatccctccatatagacattctaaactaaatccttccaacagatagaaaagccagagatactttatgtaccatatgctttatttcactgtgcaaaatgccataaaactcactccaaagccacatctggcaggtaaagtatctctggtttttcgtctattagccaactcagaatgtctatttcttcacatatttaggcagttttttgtattttgtttccttttttcacaaaatcagaaaattaatcaatagagaatgtccatagatataagaagaaataaaggtaaaattaattaaaacaacgatggattttgtattcaaaagtgacgaaactgtgaatctttcataaatgaaaatattaattaaaaatttttttataatcttgttgcaaagcaaagaagattgtgataagattaacacatatcgtactagaaatgctctagcaaagcaactatcaaataatattgataacttaaatggaggaatgaaactatggcaaagaaagttgtattagcaggtgcttgtcgtaccgcaatcggaacaatgggtggtggattaagcacagtaccagctgcagatttaggaagcatcgtaattaaagaagcgttaaagagaactaacgtacctgctgatcaggtagacgaagtattaatgggatgtgttatccaggctggtcttggacagaacgttgctcgtcaggcttctattaatgcaggcttaccaatcgaagtacctgctgtaacaattaacgtagtttgtggttccggtcttaactgtgttaaccttgctgctacaaagattttagcaggtgaggctgatatcgttatcgctggtggtatggaaaacatgtcattagctccattctgcttagacaaagctcgttttggatacagaatgaacaatggcgtattaaaagactgtatggttaacgatgcattaacagatgctttcaatcagtaccatatgggtattacagctgaaaacgttgcagaacagtggcatttaacaagagaagagttagatgagttctccgctaattcacagcagaaagctacagcagctatcgaagctggtaagttcaaagatgagattgttcctgtagaagttaaacttaaaaagaaaacagttgttgtagatacagatgagggaccacgtcctggaacaacagcagaaagtatttctaaattacgtcctgctttcaagaaagatggtatcgtaacagctgccaactcttcaggtattaacgatggtgctgcttgtgttgttgttatgagcgaagaaaaagctaaagaattaggtgtaactccaatggctacatgggtagcaggagcattaggcggagttgatccttctatcatgggtgttggaccagttgcttctactaagaaagttcttgcaaaaacaggcatgagcattgatgactttgacttaatcgaagctaacgaagctttcgcagctcagtcattagcagtaggaagagaattaggaatcaacccagagaagttaaatgttaatggtggagctattgctcttggacatccagtaggagcatcaggatgccgtatcctcgttacattattacatgagatgcagaaacgtgatgctaagaaaggtcttgctacactgtgtatcggtggtggtatgggctgctcaacaatcgttgaaagagactaatcacgtatagaatgattacatatatccgggttcggttttcgaatccggttatatcaattacatagtttgtaactatttaattatctagattgaatagttagctaatgtaatctgaaaggagatacatacaatgggatttatcgattatgaagtagatggccaggttggtattatcaccatcaatcgtccaaaggctttaaatgctttaaacagtgaagtattaaaagatttagatgcaactattgatgcagtagatttagacgcaatcagatgtcttatcattactggtgctggagagaaatctttcgtagcaggtgctgatatcggagagatgagtacacttacaaaagcagaaggcgaagctttcggtaaagctggtaatgatgtattcagaaagattgaaacacttccaatccctgttatcgcagcaatcaacggattcgctttaggcggtggctgtgagatttctatgagctgtgacatcagactttgctctgagaatgcagtgtttggacagccagaagttggtcttggaatcacacctggttttggtggaacacagagacttgctcgtatcgtaggacctggaaaagcaaaacagttaatctatactgctcgcaatattaaagcagcagaagcttacagaatcggtctggttaacgaagtttatccactcgaagagttaatgcctcaggctaagaagatggcaaagggtattgcaaagaacgcacctatcgcagttcgtgcatgtaagaaagctatcaacgaaggtttagaagtaggaatggatgaagctatcgtaatcgaagagaagttatttggcagctgcttcgagacagaagaccagaaatacggaatggcattcttccttgacaaaaacaaagaaaaagtaaaagagccatttaaaaactgctaattaatcaattatacatattgtattattaattatcggaatacattacattttataggaggttttaaacaatgaaagttggagttattggcgcaggtacaatgggatcaggtattgctcaggcattcgcacagacagaaggatacgaagtatatttatgtgatatcaacgatgaatttgctgcaaatggtaaaaagaaaatcgctaaaggatttgaaaagagagtagcaagaggaaaaatggatcaggctaaagctgatgcaatccttgctaagattactactggtacaaaagatatctgtacagatgctgatttagtagtagaagcagctcttgaagttatggaagttaaacagcagacatttaaagaattacaggatatcgttcctgcaacatgtatgtttgcaacaaatacatcttctttatctattacacagattggtgcaggacttgacagaccagttatcggaatgcatttcttcaacccagctccagttatgaaattaattgaagttatcgctggtcttaatacaccagatgaaatggttgaaaagattaaagctatctccgtagaaatcggcaaaacacctgtacaggtagaagaagctgcaggattcgtagttaacagaattttaatcccaatgattaacgaagcagttggcatttatgctgatggtgttgcttctgttgaaggtatcgacacagctatgaagttaggtgctaaccatccaatgggacctctcgctttaggagatttagttggtcttgatatctgccttgcaatcatggaagtattatataatgaaacaggagatcctaagtatcgtccacatccattattaagaaagatggttcgtggtggaaaattaggtcagaagactggtattggattctacgattacagcaaataattaaaaaagtgaatacggccgtggggactatgctctgcgtctccacggcttttaaggtggttctccaccccaataaccaatttattatggaggaatgaaaatggatttcacattaagcaaaaagcatgaaatggctagacagctctttaaagagttcgctgaaaacgaagttaaacctcttgctcaggaggttgacgagacagaacattttccagaagaaaccgttgcaaaaatgcaaaaattaggtttcatgggaattcctgtgccaaaagaatatggcggacagggctgtgatcctttaacatacattatgtgtgttgaagagttatctaaagtttgtggtacaacaggtgttattgtatccgcacatacatcattgtgtgcagatccaattcttacttacggtactgaagaacagaaacagaaatatcttgttccacttgcaaagggtgaaaagttaggtgctttcggtcttacagagccaggtgctggtactgacgctcagggtgttcagacaaaggctgttttagatggtgacgaatgggtattaaacggatctaaatgtttcatcactaacggttcttatgctgattactatattatcatcgctatcacaagtgttgatacagatgcaagaggaagaaagaaaaagaaattctccgcatttatcgtagaaaaaggaactccaggatttacatttggtacaaaagaaaagaaaatgggtatccgtggttcagctacatatgaattgattttccaggattgtcgtattcctaaagaaaatcttcttggacctatgggcaaaggtttcgcaatcgctatgcacacattagatggtggacgtatcggtattgcagctcaggctcttggtatcgcagaaggtgctttagatgctacaattgcttatgttaaagaaagaaaacagtttggcagagcaattgctgcacagcagaatacacagttccagcttgctaatatggctacacaggtagaagctgctaagttacttgtttataaagcagcaatggcaaaagcaacacagagagtatactccgtagaagcagcaaaagctaaattatttgcagcagaaacagctatggatgtaacaactaagtgtgttcagttacttggtggttatggttacatcagagagtacgacgtagaacgtatgatgcgtgacgctaagatcacagaaatctacgaaggaacatcagaagttcagcgtatggttatttctggtaacttattgaaataaggagggaaaatactgtgaaaatcgtagtatgtgttaaacaggtacctgatacaaaaggtggagttaagtttaaaccagacggaactcttgatagagcagctatgcttactatcatgaatccagatgataaggcaggtcttgaagctgcccttagaataaaagatgaaacaggcgcagaagtaacagtagttactatgggtcttccaaaagcagaagaagttctgcgtgaagctatggcaatgggtgctgacaagggtatccttgtaacagaccgtgttttaggtggagctgatacatgggcaacatctacaacaatcgctggagcacttagaaatattgattatgatttaatcatcacaggtcgtcaggctatcgatggtgatactgctcaggtaggacctcagattgctgaacacttagatcttcctttaatttcctatgctcaggatatcaaagttgaaggtgacagtgtaatcgttcagagacagtatgacgacagatatcatgttttaaaagctaaaatgccatgtgttatcacagcactttccgaattaaatgagccacgttatatgactccaggcggaatctttgatgcatatgatgcagaaattactacatggggaagaaaagaccttaaagatgttgatgacagcaacttaggtcttgcaggttctccaactcagatcgcaaaagcttctgataaagtacgtaaaggtaaaggtgtcatgatgacagctgaaacagcagaagaaggcgttgagtacatcatggacaaactgttaacaaagcatgttatctaattgtaaaggaaatgtggtgaatagaatgaatttagaacaatataaaggtgtatttatctatgctcagcaggttgacaataagattgatgccattgctttagaattacttggaaaagcaaatgaccttgctgcagatttaggaacagacgtaacagcagttttaatcggttctgacgtaaaaggcttagttgatgaacttgctgaatacggcgcagataaagttatcgtagttgatgaccctgaattaaaagaatacagaacagagccatatacacatgcactggcatctgttatcaacgaatacaaaccggacattcttctggttggagcaacagcaatcggtcgtgacttaggacctcgtgtttctgcaagagttgcaacaggtcttacagcagactgtactgttcttgaaattggtgaattcaaagctcgtggagataaagaacctcgtcagggtcagttattaatgactcgtcctgcattcggtggtaacacaatcgctacaatcgcttgtcctaaccatcgtccacagatggctacagttcgtcctggtgttatgcagaagaaagagcctgttgcaggtgcaaaggcagaagttattgagtacaatccaggatttactccaaatgacaaatatgttgagattcttgacattgtaaaatctgttacagaaacagttgatatccaggctgctaagattcttgtatctggcggacgtggagttggctctgctgagaactttgcattattagacgatttagcagaggcacttggcggaacagtttcctgctcacgtgcagttgttgataatggttggaaaccaaaagatttacaggttggccagactggtaagacagttcgtcctaatgtttattttgcaatcggtatttccggagctatccagcacgtagctggtatggaagaatctgatatcatcattgctatcaataaagacccagatgcacctatctttgatgtagctgattacggtattgttggcgatgcattaaagattgttcctaagttaacagaggcaatcaaagctcaggttaaataatttcaaatcatatcagactcattagattatgtgagttactgattgaggattgaaacttagattttttgtggaagtctagtatatgcattctcagatgttttgtgtattgacgattcattattaaaagaagcatataggagatttgtgctgaactctataaaatgtatttatgcagggaatctttttgaagattccctgttaaagtgagatagtaggactacagtttataactgtggtcttttttactttcattcagttggcatagcccgctacgccgtcttcattcaggaaaaattccccacaaattgtaacgcacatcttgcaaaagcatttttcaaactcgctctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctagtaaaatacgtcatttttattttatacataataaaaagtaaacataataaagaagtacttatcacaaaataaacataatttgtcaaaaatagtggaaattaattccaaatatgttataatactcttgcagcagttaaccgagatatgagaggaggcatttatggcacaaattattgcttcaacaaaagaaatatctaataagagagagtcactgatagtattgagtaattccttaaagaataagatttcgcttttagaaactttggggaacagtcttaattctatgtgggaaggcgctgcaaaagagaagtatgtaaagcaacttaagacagacatttcaaagatgcggaacttacttaagacaattttggaatttatattgatactagagaagattattgcaatctataataaagcagagaagaagaatgaggcgacagcggtaagctaggagggggatttatggcagatttaattaatgtaactccagagaagttaaaggcgacagcaagttctttccaacaggcaggaaaggacgttaagaaaactacttctgatatgcttcagttagtgaggggaattagtagttccatctggagtggagaggcgagtagtatatatcttggtaagtttaatggattggatgccgatatcgccaagatgtgcaagatgatagaagaagaatcacagcatttgacaacaattgcacaggaataccagttagcagaagaacagaataaacaggttgcggcaacattaaagaataatgtaattgcttagattgtatagacagatgaatagattatgctgtcagttatgattttttgtcatgacaaaagagaaggagatttaattggaaagatatgtaatcagtgtgtggcgcttatagataaagagtttttacgtaattttatcataagcgatgaagagtatcatcaggtgaatatagagggaatacagccgccagatttacttgtagtagaaatcacaggtatagaggatttatgcagagcgaaacgaataaggggattttcccgagaggacgattgctagttgtaagtactaatcagatttcagcagagtcctatttaattccggaagtttcaccagatatgcttttactgaaaccatatgtatatgcgaaagcttgtaggattatataccgaagtcttacatggtgttgtaaggataagtgtagaaagaaaaaacaagaagatatattaaagattcggacaggaggggagatttattgttttcattatgaagagattcagtatttagaagcaagagataagaagattatcttgcatgtaaataagtatgagatttctttttatagttccttgcaaaagttggagaagagcctgccagattattttattcgttgccatcgtagttatattgtgaattttatgtttattcaaaaagcagatttgataaatggtgaattttatttgaataaaaagacagttattccaatttctcagaaatataaggccaaattagcaaaaatgttgtaaaaatataaggattcaaggttcgatttaggttgaccgagttatacaacggtggtagaatatactcatgatatttttttaacaagagcagaagttgttaggaggagaagcatgagtttcattaaagaatatgcacagaaacttgttacagcagaagaagcggttaaggtagtaaaatctcatgattgggtagattatggttggacaaccggtactccagttgcattggatgcagcattagcagccagagcagatgaattagaagatgttaagattcgtggtggtatcttattaagagaaccagagattttcaaggtaaataatgtagcagatcattttacatggaattcctggcatatgggtggtttggagagaaaggcaatcagtaaaggatttgcatactattctccattaaaatattcagaacttccacgttattacagagagaatatcaagcatttgaatgttgcgatgttccaggttgctccaatggataaacatggattctttaactttggaccaaatgcatcccatatgatggcagtttgtgaagctgcagatgtaattatcgtagaggttaatgagaatatgcctcgctgtttgggtggatttgaagaaggcattcatgtttctcgcgtagattacatcgtagaaggcgagaatccagctattggtgagttaggagctggcgcaccaccaacagaagtagacaaagccgtagcacagcttatcgtagaagagattccagatggagcatgtttacagcttggtatcggtggaatgcctaatacagtaggttccatgattgctgaatctgatttaaaggacttaggtgtacatacagagatgtacgttgatgcgtttgttgacattgcaaaggcaggaaagattacaggcttaaagaagaatatcgacagaggacgtcaggtatatgcattcggtgcaggtactaagaagatgtatgattatctggatgataacccagaatgtatgagtgcaccagttgattatacgaatagcgctaagacaatagcacagattgataactttatttctatcaataatgcagttgatattgacttatatggtcaggttaatgcagagagtgcaggtataaaacagattagtggtgcaggtggacagcttgatttcgttcagggtgcatacttatctaagggtggtaagagttttatctgttgttcttctacatttacatccaaagatggtgtaaagcatacaagaatcagacctactttagcagaaggatctacagtaacagatactcgtcctaatacacattatgtggtaacagaatttggtaaggtatgccttaaaggtatgtctacatgggaaagagcagaagcattaattaatattgctcatccagatttcagagatgaattaattaaagaagcagaaaagatgcatatttggagaagaagtaacaaataataatcacagctttgaataagatatcatatgtcgggaaattagctaaaaagtaaaaatttaaggcaagatatcaagaaacctctcacacaaaagataaacaaactgcaagtttgagatgattttgtgtgggaggttttttaatttaataaatatttacagctagaatgtttttcaaacacgctctagaatatttacaagtaaataatattaaaaacagtagtgtaataattgtggaagtatcaatgtaatatttatttagaatctaatatgtttataaagtttattctgaatgtaatattactttaaaacaagattatcaatatttcttatgataatcgttgatttaccagttacatctgtttgaacttcaaagttagccagtttgttataagtttccattggaatagatatttcaattccgctatcagttaccatgacctgcttttctaatttctttacagtactttcattggtgacagtaaagttatcatattgtaagtcgtactgttccattttttcatcaaattctgattttttttctggactttttccgaaaagtttattacctatttcttctatatcgaaagatttgttatcaacgtattctttttgaagagcactttttgtatccatctttgtttttaaatcggcaccatcgtatttattagaaatattattaataacacgagtaagaatatttaacttcttttttggaggaatactggtacggcagacaagaaagttttccgataaataataagctttctcaccatttatctcatactttttctccaaaagctttatgtgataatcggataaattaataactacggcctcaggtattcttgaagttgcagaaggaagcagagaatgtgttttgatgatgtctgtattaataacaggattatcaggaatctcggtgatttcatgcgtatagctttccttgtaattcatttttaaaagggcaagatagataattccttctgcctgaaaggtcacgaataataaatcggcagcgggtatatctaatccttctcccatggcaacatagagtttatttgcaatggcctgactggtttcaatgaaagaagtttcatctgattcatcccatgtttctaagatggaatagattggagaatattctgggtcaaattcacagtttttggtatcatcgctggaaacaattttataaatatggtttcgaataaaatcatgtaaatctggccctggatctaagagagtattagaaagaatacattctccgcgattggtgtctaaaatatgcaaaatagcttttcttataacaatatcatcttttgctatcatgaggcagctcctttattttttatttgattaaatagtataccactttaggagtaaagaagctatgagatttttaatttttatatacggaaaaagcaggatgaaacgcacacagcttgtcagcggtaagagagcagagtgtcatatattattacctaaagatgatttctctttggaaaggacagtatttttacagtttaaaaatatatctggagaatggtttatcaaggaaacagactgttgtcatttgaaaacagaagaattttttcagatgggaaaacggaaaagtgatgaaggaatattttacaagttgtcaatagggagaaagaatgaactatcggtaggtgggaaggatctttatatacagcttatacgatataggaatgactggagcatatataagaaatataaacttagagattgtcggataataaaagagaaaaatatattcataatgatggagaaagccattaatagaaaaaatagtatgggtatttcatatgagtatggcaaatggttcatagagaaatgtgggaatatagaaatatatattaatgaaattttgttagagaaaaagcagcaattagagtttggtgatgttatatgtattggaactatatatttgttattttttgagaactatatagcagtagaagctggtgagagaaatacagtatcagattatttggaagaagtaatattagaaaatgagataaagggacaagaggatgttaggaagaaggaaaaaagagagataacttttcacagggcaccgagagtaatggaagaattaaaaaaagtatcattaaaagttgatgcaccgccccaagtggatgtacaggagaaaaaatctatatttatggatataggtactatcatgaatctgatgtttccaatgttaggaatgaacttatttttaatttatggaatgaaatcagagcagaatcaggcaggaatatatgtatattctggactgtttatggcagtgatgtcagcggtatgttctattttatggcttatgatttcgagaaagtatgaaaaaagagaacagcagaagaaagttaataaagagcgactggcttataggagatatttgaataaaaaaagtgaatatatcaaagtgcagtatgaacgggtatataaggttttacaaagtagatatttacgggcagatacttatttagatagcccattattagatatgtatttatggaatcgaaatctatatcataaagattttttaatgtacagaattggtataggtgacgttgagtttcctatgaaaatagaatttcctgaggaagtgtttggcgatgaggaaaatattctatggcgggaagcaaaaaagataaaggaacattatgagattctacatcagattcctgtgttactcgacatgggaaggtatagtcagattggaatcataacaaaagatacgatagcaggaatggaacttgtaagaagtattattttacagattgcgttgtgtaattgttatacggaagtaaagataggatgtatttataacaaaaataaggttattcaatcgcagcaatgggatttttgcaggtggcttccgcatatatgggatgccaatagacaaaagcgatttattgcagggaatgaggtagaagcgaggcggttattctatgatttgttgcagatttttaaagaaagagaagaggtatccatatccgataagtcagaaaaaattttgccacattatattttatttgttgcagaagaacaatttttggaaggagaaatgttttctaaatatattttagatagaggaaaagaatatggattgacagttgtatggctggactcgatgagaaaaaaattgccgaatacatgtaaaatggtattggaaataaatgggggatttactgggcggtatgagatagaaaggcacagtcagaagaaagagaaaataaattttgattatacggaaaaaaatattgcggagaaattaataaggagtatttcaggaataaaagtgatggaaattgaagaaaaggctggtataccagaagttgttgattttttaggaatgtatgatgtgcacacgatagaagaattacatataaaacagcgatgggaaaagaatagaatttttgaaagtgcaaaggttttaataggtaaaaaagcgggagatgaacctttttatttagatatacatgagcgatatcatggaccgcatggtttattggctggaacgacaggttcagggaaaagtgaagtacttcagacatttattttatccatggcagtgaattttagtccggaagcggtgtgctttttgttaattgattataaaggagaggggatgtcagcgctattttctgaattaccacatatttcaggaaaaatatcgaatttatcagatgggcaggcatatagagcaatggtatcaataaaaagtgaaaataaacgaaggcaaagaatatttaaagaatgtaaggtaaataacattaatgattatacaaggttgtttaattcgggaagtgtaaacgaaccaattcctcatttactgattattattgatgagtttgccgaattaaaaaaggcggagccggaatttatgcaggaattaattagtgttgctcaagtagggaggagcttaggtgttcatttgctgctggcaactcaaaaaccaggaggtgttgttgacgataagatatggagtaattcaagattccgaatttgtcttaaagtgcaggaaagggaagatagcatggatatgcttcataacatggatgcctgccagattacacaaacaggaagaggatacttgcaggtagggaataatgaagtatatgagttgttccaggcaggctggagcggggctttatttcagcaagaggatacggaagtggcagcatgtctggttcaaacagatggaaccatatataaaagaagaaagaatgctgagaagaacagaaagaaaaagataacacaattgcaggcaatcaaacagtatattatacgttttgcaaaagaaaaggaatatcaagagggaagaaaattatggctggagccattggcgaagtatatatatttgaatgagattcacaaagaaatgaataaagataaaaagttaaaagagaaaaggcaaagagttgacatgaataagaacttggaagtatgtgtcggtatttttgatgatcccgaaaatcaggaacagtccatattttccttaaatcttatggaaagcggacacatagctatctgtggcagaagtgcttctggtaaaagtaccttttttcaaacatttctattttcattattaaaagagagtacagcagaagaagtatgtttatatctgttggatttcaatggaagtggtatggacatatatgatttaatgccccaggtaaaacaggttataaaagaggaagaagaggataaagtagaagaattatttgaaaatataaaaaaagaaatgaaaagaagaaaaaagaaattttcagggggtaattttaagcaatataaaaataagagcaaaagaattgagaataagagcaatgaagataaaagagatgttggaaaagaagataacgtttcactaaatcaaatagaaaatgagaaagaagagtttccgctgattttaattatagtggacgggtttgttgaattttgtgaggaaacatatcagagatatgatgatagcctgtatttgatattacgagagggggaaaagttaggaataaaagtaatgatttcgatagaatcattttctggaatgtatatttctatgagaatagcagagctttttaaaacaaaaatctgtttatatatgaaggataagtatgcctatacagaagtttttgatgtaatacaaatttctgtatttcctaaggcggagattccgggacgtggcattgcttattatggagagagaattttagaatttcaaacagcattggccttgaatgtacataatgattatgaacgccgggaaaagataaaagaagtactgaataggggagttgccgatggtatatgttgatgtttttgttgcaggtgtaggaaagtggtatgagtttaaatgtgaagaaacggcattgataagagatatcataaaagaaatatatgatgtaatacgggataaggaaagcattatttgtgagaaacagatagatctggaactctatctggcatgtatagaaaacaaacgaatattacctcttgattttaaattagaggaaagcggagtagagaatggaaatagattaatacttttttgacggatgtgatggggagatgttaaaggcaggttttgtgctagatggaaagtatagaattctatcggtaatcggacaaggggaatgagtacagtatatttggcagtacacgaaagactaaagcaaaaatgggcggttaaagaaataagtatggaatattgcgagaattacgaaatgataagcaggaagctaatagtagaggcggatattttaaaaagattggatcatccaggacttccaaagattgttgacattatagagaaaaaagatgctatttggatggtaatggagtttattgagggaaaaacattaaaagagattttaaatgaaagagggcggattgaagaaaaagagattttaatatggggcaaacagttatgtgaagttctttcttatcttcattcgaaaaagccatcaattatttatcgagatttaaaaccagagaatattatattaaaaaaaacgggaagattagttcttatagattttgggacggcccgagaatattgttataagaatacggcttgtgatgcaatgtatcttggaacgaaaggctatgcagcaccagaacaatatggaggtatggggcagacagatgcgaggacggatatttattgcctgggagtcacgctttatagcttattaacgggatataacccggaaaagccgccctataagatatatccggagaaatattggggagaacatatatctttagaaatgaaaagccttcttttaaaatgtatacaatcagagcctgaaaaacggtatcagaattgcagagaacttgcctacgctttatcgcaaatagattataaaaagcagaaagaaaaggagaacgagagaaggaaaataataaagtttttgatttttatgatggtaggacagttatctttgatgttttgtatagggtgtaaaaaggtatcattttgttataaggaagaagcagttgtaagatatataaacatagcagaaaaaagtgaagataaaaaggaagccagtcaatattataagctggcattagaacttataccagaggaaaaactgatttatcagagcatgataaagtattttattcgtctaaatcattttcagatagaggatgcagtaatattacttgatcttataaattctgtctgtgaagaagggacggtaatagagatctttcaaaaacacaatgcgttgggatatgcagaatttagttatgctttaggcttgggatatttctatgatatgggaaatataacgggaaaaggagcatcagaaaaatggttttgtgaagctattgatacgatgacttcgcaagatgagaatgaagcgtttggcaagcaaaagagaaaaagagcaggtttatatgcaaagatagctaattattataatacatttttgcttaatggaacagatcaaagtggagaaagaggaacaggagattttatggacttttataaaacgctccattctctaaatcaatttgaagtgacacaaaaaagtacaaaatcagaccttgcagcagcatatttaatttcacgggagattaccatagaaattatgaattatgcagagcagttcttaaaggatagttcaataaataaaaaaatgttaaataaagaattagaaaaaatagaagagagaacaaagtattttataaaggagaaaaaacaaatggaagaactatatcaatttatgaatgaggcaaagcaaaagatagagatagcagatagttttaaagacaaggaggatgtgagggatgcaggaggaacttaatacacgactattacaaaagataagctatctggaaaaaggtgcggtgttagggatgatagtatgcagttgcttttttctggcggcaatattgtattttgtaaaagcgaatgtatatgtaatattaataagtggtttgaaaaagaaagtagctcatgtgagaaataaaataaagagaaaaagagtgagacgaataggagacaaggggaaaaatgagataacgaataaagcttattttaaattaattgtattagcttttgtgggagttggaagcatctatacatatagaacatactacgtagaagcagctgtaatcacacaattggcaattgatgaagatacagaagttatggataatactgctggtgacataggggaaaaaagtccaaaactatatttagagtcaaaaggatggattgggggaacgggagaatttgcacaatatctttttagtaaggataataggacatttaccataggtgtggaggaaaatacgtttcattctgacttagaaaaagagtcatttttattccaggtttcagagaaggaaagtggtattgaccaagaaggttttaataagattagacagtatgaacaaggggagtttgaaagaaaagctagtgacaatccaatctatcaaaaaacactttcttttgagacagaaaaaaacagacataaagtgtatagcttgtatctggaatatataaatagatggggaatgccattaattggagataaaggagcggtagaaaattacggaaatattttatcaggaactttcaaaagtaaaaagctggtgattgataaaaaatgtccggagatagcaggattaaagcttgagaaagcagataaaaagaaggaaggaataagatttgcgaagaaatctgtcagtgaaacttataatacagatgaaatatataataccgataaaaaatgcaatacagatataacatacaatatagatgaagaatgttattacaatacgtcagtaaaaggaatgatagatataagggaaaaataccttgatttagatagtatacatatccaggcgatgccattagatgatagggcgagggaagcagtcaaagaaaatgaagctgaaagtaatgatggtatgttagacattttggcatggatacatactaaaaaaggaaacttacatcaaatttcgtttgattttgctgtagaaggaaaatggaagtttattcttgattgctctgatctggcaggaaataaaggagtatccaatcagacaggacaggaagggatagagagtacagacattacgatagataagtcggcgccagagctatcggttgattataaaggcattattaacgttatggaagcggaatcctcaccggcaaatataaataaaaaattaaagagtaacggagaaaaaattacttcttctggaaatgaattatttatgaaaagggaaaattcgattgatatttgcattgaagatatgaatttagaggcggaaaatatagaattaaagttatatcgtgtaaaatatggtctaaatgggaaaatagaacagaacaaagaatcatgggaggaaataacagaaaaaataaagcaggagccagaaaaacaagaattagaaaaaggagagcaagagaaaaattccaaaacagtaatgcgatattctgttacaaatctcgatgatggccattataaacttatgatacattgtacagataaagctgggaatgttatgacagctgaaaagagtagcgagacagaaaggtgtatttataatggatattatgaaagtccactctataccgttgatacaaagagtccattgataacaagtgtgattcttaaccagaatgcagtgaaaaagataggaaaaagacagtattttcaaaatgctcctcagattacaattaaaatacaggaagaaaattttaataagataaatttttctttagaggggaaaatgttttattcaaatggaatggttatggagaaagaatgggaacgttttaagagccagaagaaaagcttacaatggaagtcttattatgaggatggaatcagaattaatgagacaaacatacaggtagaagctgaaggaaattatacattaaactttggggttattgatagtgctgcgtgtgtagcaaatcagaaaaacttgcagataacatacgattgtcacaaaccagagattatttatacaggagttgataatgagagtggagatttgatttttaaagcagaagaaaatggagatgataaaaagaaaaatacattgttattgtttcataaataccattttttccgatattttagtaaaagaagaatgaatgttttcattcggataaaagatgctattagtgggatagagagaataaattatgcttttattccatatgaagaacaaccaatagatataaataagttttcccaggtagaaaggacaggagcagagaaaataaatgatgaatattttgaaaaggaagatttgtcagagttttctatcacagtatctcctgaaaaagagaattttaaagggtatctaaaggtttatggacaagattatagcggaaatgtaagtgagatggtgaagagtaaaggtgcaatttcggaatcattgcagctacataaagagacaagtaatataacaatgaaaatgccgcgggctttttttacggataaagagaagaatataagatattataataatactgttccggttcaagccgtatttgaagacacatatgcaggaatttacaagactcagttatatgccaaaacaacaaagaaaaaggatagttcaataaaaacgggaaagacaattatgtgggatggagataacttaatttatcgaaaaagacaacagattgaattagaggcagataaattttcacaatttgatgcagataatccgctgactatccaggcagatttagaagataacgctgggcatacagagaagaatatattgaacgaaaaagttgtcatagataacacaaaaccagagatagaagtggtgtatgatcagaataatcagacacaatattataatttttcaagaaaagcaactgtgacagtaaaggaaaagaatttttcacctgatttggtagtgtggaatatacagggaagtaatcaaaaatatcagattggagaatggaaaaatgtgcagggtacctatgtatgcgaaattagcttcgaggaagatggcagggactattcggtagggctgtcggtaacagataaggcaggaaataagtctgagtggaaagataggaattattttacgattgataagaccgttccacagatttctattcagataaatggaatcggaaagcaggctgatcaagtcccatattttaatacggaacgaattattacattttgtatacaggaacagaattttgataaaaataaagtagaatataatatagatgcaattcatgggaaaagtagaattactataaaaaaaccagtaaaatatcaggaagatggagacaaatattatagcaggctggtgctaaagaaagaggcaaaatatcatattcgagtaaaatgtacagataaggcaggaaatgtctcagaaacagcagagactaaagaatttataatagatacaacgactcctgctgtacatatagctggagtaaaacagaatggaatttatcagggaaagaagataatgccacaggtaatatgtaaagatcagtatttggatagagaatctgtggagatttctttaaagaaaatagatgataggaatgttttgaaaaaagaatggagttacgaaagagcagaaagtgaaaatacagtacaggtgcagtgggataatattaaaaagaccgaaaatagcgatggaatatactatttacaaattaaaggacaagataaggcaggaaataaaattaaggatgattttaaagtggtgttccgtgtgaatcaacggggagcggattttattttaagccacgcattaaaaaagaagataaataaatattatttgaaagaagcaccaaaaatcaaattgagggaacagtgtgtaaagcagacgaaatcaagggcggttattttaaaagataatgaagagagaaaggtgataggtgaaagtagcataacaagtagtgtgatagcagataaaaagtcagaaaggtatggctggtatgaaaaatactacaattttgctaaaaaagactttgagagagagggggattatcgtgttacatttcaagctgatacgaaagaaaaggagcttcggtttgttgtagataagactccgccggtagttcatattggcaatttggataaacagatctatgaagagaaagagcatgaatttactattcgtgtaatggataattatgcatttaaagaactagaattatatatggaaactgacagggatatattaggtcagaaaggaacaaaaaagattattataaaaccgaaagacttagatgaaaattatatggtacggaagacacttacagcagataaaagatatcagacagtgcgttatatcgcaagagataaggccggaaatgtaatagattctaatgataatggggacacaaaggtttgtcttgtaacagatagtaaaacggtaaaagaatatcaagaacataaaaaagaatatatgttaataggtattataagcacattgggaatatttatcgtaatcagtggactctttatttttactagaagaaaaagaaatctgaaataagataaatatataaagaaaatatagtaaaagaaaacagaaagcatttttcaaacacgctctagcggaaacagtaaatgagataatggaagaacaggaaagagtagctcaaatagcggatgagataaaaaaagggataaaataagtaaaataaaagaaaatagaataagatagaaaaagcgaaaataggaaaaagaagaagactttgacgtaaaaaatattttctgctatagtgaattttacaggaagattaattgaaaaaagagaaagcaggggaaatatggagtttaaagtaggagaaattattaaaatgaagaagaagcatccctgtggtgctaatgagtggaaattactcagagttggaatggatttcaggctgcagtgcatgaactgtggtcgtgaggtaatggttccaagaaaactggtagagaagaacttccggggatatattcatcaagatatcgactagagtgtgtttaaaaaatcagactatataagcagcataggagatattttaaagatacatataatagcaaaatgaacaaaaaagaaacaatataagagaaaattttatataataaaatttgaaaatgaaacttgagtttgtaagtgctttgtgatataatggacaactgtaatgtgtaaaaatccttgttctcttaaatatttaagagagccagaaagaccaaaaggaggtgcaaatgaccatgaataagtatgaattagctctggttattaatgcaaaaatcgaagatgacgctagaacagatgccattgaaaagattaaagctttaatcgaaaaatttggcggagagattactaacgttgatgaatggggtaagaagaaattagcttacgaaattcagaagatgagagaaggatattactatttcatccaattcgatgcatcagctgagtgtccagcagagattgaacgtcgtgttcgtatcatggagccagttatgagatacttatgcgttaaacaggatgcataacgaataggaggaattccatgaataaagtaattttgatgggacgtttaaccagaaacccagatgtgagatactcacagggtgagaaggcaacgtgcgtagcaagatatactttggccgtaaacagaagattccgcagagaaggcgatcaggatgcagacttcattaactgtgttgcttttggcagacaaggtgaatttgctgagaagtatctgaaacagggtactaagattgtcatttccggaagaattcagacaggtagttataccaatcgtgacggtgttaaggtatatacaacagatgttgttgttgaagaacaggattttgcggagagtaaggcagctgcttccagctatacaggtggatatcagcagcagggaggctatcagagtgctccagagccacaggctgcacctgcaccgacaaaccgtccagccccaagtgaggcagtgagcgatggattcatgacaattccagagggaattgaagaagaactgccttttatttagagttaaggaatttaggaggtaatatcaatggcatatagcaaagatcgtggcgatgctccaatgagaagaagaggtggccgcagaagaaaaaaagtttgcattttctgtgcagacaagaatgcagtaatcgattataaagatgtaaataaattaaaaagatacgtatctgaaagaggtaagatcttacctagaagaatcacaggaaactgtgcaaaacatcagcgtgctcttacagtagcaatcaagagagcaagacacgtatccttaatgccttacacagtagagtaagacatactaattttgcttgaatatgccgcggcaactatgtgttttagttaccgtggcattttttaaaatagtcaattgttcctgatttgtagcgcaataaggcgcttctggaggtaaaaatgaaaaaaagaggaattttaaacgcgcaactttcttatttactcgcagccctgggacataaggatttatttatgataggggatgccggaatgcctattcctgaaggagtagaagtagtagatcttgtattaactgcaggagtaccaacatttaagcaggtattagatgctgttttagatgaagtacaggtagaagggtattatctggctcacgaaattaaagaatttaatccagaattagaagagtacattaaggcaggtcttcctgaagcagaagtagaatacatgccacatgaagacttaaagaagttcagcggtaaatgccgttttgccatccggacaggagaattttctccatatccaaatgtaatcttaagagctggagtggtattttagattactatttaattcattagacaaacaacagacgaagccattgcccccaataaggcatatttgtgattttagtcgcggcggtttgaatgttcgctcatgcgctcgcatccaaaccttgctccgaaaccacaaatatgccttattgggggcaatggcttctgtgctgtggctggaaggatgaattaaatagtaataatatttttgttgaaagagaccaaaaaacgcgctatactattaaataacacaaaaattattttctatcatccagaagaaagggggagtctcgtgtccaaaattagaattcatcaaggttcaagggatttatatgtgaatgttatcagtgtgaattccaggtatgtagattttattatacataatgatttatcaatagatatgaaggttcctgttggaatgagctgggagatgatagagcggtatgtacgcctgaatgaaacgatgatttttgaggaatatgagaagaaaaaggttcgaaaccatcagatgcttccaattactttggatttggaggaaggaagaattgtttaccgaggtgggctataccttccatttcttgggaagacagatgttcttcttaggataaagtatttatctgattttgatgaggaagaaactaagatttatatggaagataaaaaggatcagggtaaacatttgattattaagacagataaggatagccaggaatttctgcggtattgtatcatgcgttattataaaaaatgtgcattgattattgttaaaaagaaggtagaagagtttgcacagaagatgggacttcagtataatcaggtaatgataacaggtcaaaagaggcagtctccactgcgacggccacgtctttcatatcagaatattgagattaagaatcagctgacagtgtggggaagctgtaatcgtaagcataatctgaagtttgactggaagctggcaatgcttcctatggaaattatcgaatatattattgcacatgagctgacgcatttaaaagttatgaatcattcggctacgttctggaatgagatggaaaaggtgatgccggaatataaggaatgtcgcagctggcttgaaaagcatggaaaagaatatgagattttttaagaaagaagattttgatggcatgtaatttacatataaatgtatgaaatgattagaagatagcaaagggagaaaaacacactctggagcatttttaaacatgttttagcagattaaaagtagtaaggatataaataaaaaagttcgggaaaccggacttttttattttctgacgaagatataggaaatttatgttataattctggtatgccagatataactttaatttataattttttatatattaaagtgtattggaataaaaatagcatttatataagctgcaataataatttctgaattataaggtagtatatttaatgaatagttgcaaattataaaattattttaatttatagttaaaagttatagaaatataataatacttgaaaaaatgaggattataagaagcagaataatgcctagaaaaatgaggattataagaagtacaataatgcctgaaaaaatgaggattataagaagcagaataatgcctgaaaattagaaattataagaaatataaagggtaagatttaataacaaaaggaaaatattgattatgaaactagacgaaacaaaaagacagaagattattcatccaattccgcctctttatgataaagattcaaaaattttgatattggggagttttccttcggtgaagtccagggaagaggcatttttttatggacataagcaaaatcgtttctggaagcttctggcgggaattctttcggagaaaaaaccggaaactgtagaggaaaagaaggatttccttcacagaaactgtattgcggtgtgggatgtgattcatagctgtgatattataggatcatctgatagcagtattcgtaatgtagtgccaaatgatttatcagagatattggaaagtgcggatatcaggcagatttactgtaatggtgcgaaatcatatgagtattaccgaaagtatcaggaaaaagaaaccgggagaaaggcgaagaaacttccctcgacaagtccggcaaatgcagcattttctatagaaaaattgacaaatgagtggaaggaaatctgtggcccattgcaagtggcaccagcgggtatcgggggagttttgcttaactggtatgattataatgcaaggattttgccgtggagaagtgatccgacaccgtatcatgtctggatttctgaaattatgttacagcagaccagggtggaggcggttaaaaagtattatgaccgctggatggaaagtctgccggatgtgaaagctttggcagaagttcctgatgatgaacttatgaagctttgggagggactcggctattataatcgtgctagaaatttaaaggcggccgcagttcagataatggaagagttcgatggagaaattccgtcagattattccaaattgttatctttaagagggataggggagtatactgcaggcgcgattgcttcaattgcatttggtattccagagtctgccgtagatggaaatgccctcagaattttttcaagaattcttgcagaagatggggagataaataaaacttcagtaaagaaaaaaataacacaggaagtaaggcgtgttttgccagaagaacgtccgggagactttaatcaggcattgatggatctgggatcttcgatttgtattccaaatggagaaccattttgtgaaaattgcccatgggagtctatttgtaaggcacataaatacggtcaagaaacagattttccagtgaaagcaaaaaagaaacagagaaaaattgaaaaaaaggctgtatttttaatagaagtatctgataagattattttgcacaaaagaccagagaaagggcttttaagtggattatgggaattgcctaatcttgatggcgagctttctgcaaaagagttatctgaacagatgaaaaaatgggaaatcggagattatatgatagagccattgggtgagggaaaacatattttttctcatgtggaatggcagatgaggggatatcgtattcaaatgagagacatttcagagaaacttttagaaaaggaagaatggattgccgtatcaagagaagatttagaagaaaaatatgcaattccttcagcatttgaatgttatcggaaacaaatttatcggggatagatttgaaagaaacaattcttgctgagggattatagaaagaagatttattgagagtaggcttgagaaaaacaatccttattggtaggctagaaaagtagatttaccaagaataaaattgtaaaagatagtcattattagtgtgtataaaaacagattgataaaaatagatttatttgataaaaacgcactcgctaaaaagtagaaaaacataaaataaataagaaataaaaatagagttatggaaaggaaacattatggagaaattaatcgtacttggaacgggaaatgcttctgttacaaaatgttataatacttgttctattattcaggatgaaaagggaaaatattttatgattgatgccggaggtggaaatgggattcttactcagcttgaaaaaatgaatattccggttacagaaattcatgatatttttcttacgcatgaacataccgaccatcttctgggaatgatctggatgattcgtgttatcggacaggcaattcagaaaggaaaatatgaaggaaattgtacgatttactgccatgatgggctggtgaatgtgcttaagacaatttgtgagctgacattagttaagaagattaccaatcttattggagacagaattattctctgtccggtgcaggatggagaggaaaaacagattttagattataaagtgaagtttttcgatataagatctacaaaggcaagacagtttggatttgtgacaactttaaataatggaaagcgtcttacattttgtggagacgaaccataccaggagcattgttttgaatatgcatatcagacagactatttccttcatgaagctttttgcttagatggggaaaaggacgaatttaagccatatgaaaaacatcatggtacggtaaaagacagtgcagagctggcgcaggaattacaagtgaagaatctgttattatggcatacagaagataaaaatattcgtaagagaaaatctctttataaaaaagaggcaaaaaaatattataaaggtaatgtgtatgtaccatatgacagggagattatcgaattaaaataataaaagctgatatttacaatatattgatttattagcatacttgataaaataagcatacttgatatactgatggcatatggaaaacatatgtaatattttcaaatgaagaacatttggtactttcttttttaaattaagaagcacccaatttaataaggagtagtttagaaaattgagtggtaattattgatagtttaattgatagataattcatattgttgatagaaaggcaaatgaataaaaatgaaaggaaaagtttatgaaattcagaccatgtatagacatacataatggaaaggtaaaacaaattgtcggagggagtcttttagataaaggagattacgcacaggataactttgtttccgaaaaagatggagatttttatgctaaattatataaagatgcaggtcttgaaagagggcatatcatccttttaaatccagcaggcagccagtattatgaggaagatgtacggcaggcatgtctggctctttctgcttatccgggagggcttcagattggtggtggaatgaccgcagagaacgcagcattttttctggaacagggggcttcacatatcattgtgacttcttatgtttttaaggatggaaaaattaactatgaaaatcttgaaaaaatagttgcagtaactggaaaggaacacctcgttctcgatttaagctgccgtaaaaaaggagaggattattatatcgtcacagaccgctggcagaagtttacggatgtaaaacttaccgaagatgtattatctgagctcgctgattactgtgatgaatttcttgtacatgcggtagatgtagagggaaaagcaggtggaatcgaggaagatattgccgcattacttggcaactggaatggaatttcggtaacttatgcaggggtgtaagctcctttgaggatttgagaaaattaaaagaacttgggagaaataaggtggatgttactattggaagtgcactcgatttgtttggcggggaaatgccattctccaaagtattagaagaaataaacttctgatttgtgaggctgcggagcagacgaactcctgaagataaataaagcatatttgtgactttagtcgctgcggtttgaatgttcgcttacagcgctcacatccaaaccttgctccgaggccacaaatatagggtatcggctctctttggaagcgtctcctttgctgcgcaactcaggatttttctttcgaaagagcaatggtaattcccttatattttgccttatcccgaagaatttctcccttgccagatgccagataagagcaggctgtagaaacagataacacccccgtctggctggcaacaaattcagaagttgcgatgccgagttggctgatatccaatttttcaattttttcggtaggtatgattttcagtggcacgtttaaatttgcggcggttccaatgattccaggttcatcagatttcagaggaatcgtcgcaatgcattttagagaaagagggtggaggccctcttcttttaatgtctgtaaaagtgcttcttcaatcggcttctgttccatgtttctcttgcagccaatgccagcacagatagtacgcgggcggagatagaggattggggctgaagaagggatagtggagcattcatttagagaaaatccttcatcaattactacaatcgggatatcagattcaatattatcgatgttagtagagggtgacatgataggagttgttttgacatttttatcatcggttactgcaatattatatgtttctatatgactggttataatattttttgatcttaaatttgcatttaaatcttctgttttagtattatttttatttcttatatagattttgaaaaaatcagaaagtgaaaaaatatcgatcattcctcgtttctgttcttctgctaattctggataaagttcctttgcatttttattagtaaagacatttacctttttaccagcaagtaaagcaccgctgatatgctttagctgaccgatattttcgattgccatatcatatttttttgcaaaagtatcaaaggagagttcgcctgcgacatcggttgctgtggtgattacagcttcgccgccggaaatggctgccatttcacgggcaagatcatttgcaccgccaaggtgaccggaaagtaggctgatggcatgtttccctttctggtctaaaacgacaactgccggatcactcgtcttgtggacaatgagtggggcgagaatacgcacaacgattccggttgccatgatacagacgagagaatcgtatttgccaaaacctgctcgaaggttttctttaaaattttctttattataaatatcaccgggatgagcggtagcaagtttgtgggcgagtttcccgccttcatcggtgaggtaaaagtaagcggtgttcataggtaaatcctttcgtttgctataaatatacccccacgccggtttggcaatgggggtaactattatacaatagttgctgttaatctaaagataccagtgtcacatcatgctcatgttcttcgataatacggattaaatcctctgttttgagccatacagtagcagtattatcatttggatgaactccaacaagacctggttcttcaagaaaatgtttatcaagataaaaatgtactttcttttccgtatcatttaagattccaagaggtgttacagcaccaggaatcagccccataatgtccataagattttctgcggaggcaaagcttaatgggcgggttccgttggcctttctaaattcttttaaattgacgcgcttatctccgcgaacagtgataagataaaagtttttctttttatcatcacgaacaaaaagattctttgcatcagcctcagggtaaggggtatcgacttcggcaagttcagccatgttgtagacggctttgtgctctgtaatctcgtgccagatattattttcttttaagtaattgtaaatgtcctgtttattcataatagagttgtctccttttgatttcataaatctctatttgattttgaatcagcctattgttatttaagaaaaaaatccaattttgcagtacttatagatgttcaacttaaatttgttgtactagagcgtgtttgaaaaataaaagttgcacaaaacatatattcccacgccctttttcatgataaaataaagaaaaaaggggagtttattatgttgagacgatatgaattaacagatgaagaatggaatcaaattgtttctctactgccacctgaaaattctggcaaacaaggacgaccatccaagtgtaaccgtaccattcttaacggaattgtctggattgcccgcagtggagcaccttggcgtgaccttccagaacgctatggcccttggcaaactgtctattctcgctttcgcaagtggatggaagacggtatccttgataatatctttcgtgttttaagccttgatgcagaattaagcgaattatcaatagatgcctccattgtccaggctcatcaacatagtgcaggtgcaaaaaaagggggccatccaacgaaatcggacacagtcgcggtggagcaagtacaaaaatccatgccattgtagatgcttatggttatcctgtttatgttatgctcagtgagggacagcgtaatgatattaattacgccatccctttgctagaacaagttgacataaaggaaagtgatatactggctgaccgcggatatgatagcaataaattaatggactatatctatgcccatggtggtgagccaaccataccttccagaaaaggggctaaatttgaccgttactgtgactggcatctttacaaagaaagacatttagtggaaaactattttctcaagttaaaagcattccgtcgaatagccacgcgttatgataaattagcatccacttttgcagcatttatatgcatcgcctcaatattaatttggttaaaatgaacaacttaaaatgtttttcaaacacgctctagagcatttttcaaacacgctctaattctcgctttttccagctcacaaatccatacatatcatttaagagaaaaattgcaaaatttactacaacaggaatgtaagcaggattctccagagaagcaagtacccagagtacaatcagcacgatatcattcgcagcatatcccacagcgtaatacgaagaacgcagcatagtaagagatgcggcaataaaacttgtcacgatagacagggtactgaacataatatttggggtatcaagccacgcaaggatataataaaaaatgccagtaacgataactgtgctgatagttaatccgataatgtgctttttatttaatgtccgaatcgccacttcattttcattttcttcggatggatttcgaagccaggtgattgctgaccaggcggccattggtaaagtcattccgaggtaggtgatcatttctccccagtagtgaaaacggaaagaaatgataccatacaaaatgcagaaaataatcattagaaattgcgcccagacatttccctttgcggcaaaaatcagtgcggtaacaccaaggagtgccgagattaatgtcaataaatctaaatcgttagttgcaagatttgaaagaatgacaacagtaagagaaacgagccagagaagccattcttttttagttaatgtttttaatggattatttaacatagaatacgcggccttcatttctcgctggagcagcaggataatcgccatcagcatagcctaaagcacaatgaccgattccttcataatcaccgttaactcctaaagatcttaagagatttctgccccagtcagatttaaactcttcttttgcacgatgaatccagcagcttccgatgccaagttcatgtgcggcaagcatgaggttacccataacaaggcttccatcgtatacataagttggacgttccttctttgcaagaacaatcagcatggcaggtgcaccataaaatgggtcaaagccttctttccaaccgccaatctcacagttcattttagaaatttcgtcacgaagctctttctttgtaacctgaatgataattggggactgttgtcccataccacttgcagcataaagacctgcttcgataatctgatctaaaatctcctgtggaaccatgtctggtttaaatttacggatgcttcttcttgatttcattttatttaatacgtcgctcataatattcctccttgaaaatgtatatttgatagcatagagcatatttaaaaatcaaaaagcaatctgtatgctccaatgccattaagttcttaaaaaatgttaccctacaattataatcggacatttatgctaaagcaataggattttgctgtttaattcattaagcgaactacagacgaagccagtgaacttcataagtcatatttgtgcttttagtcgcggcgcgttgaatgttcgctccacgcgctcgcatccaacacttgctccgagaccacaaatatggcttatgaagttcactggcttctgtgctgtggctgaagaacgtgaattagacagggagaggggatttagggacagaagctgatgtcttctgcttactcgagaatgattgggaacaaccataggtatgtacatataactcataaaaagaaaatatatctttttaatgactatcatcggaatatttcaataatttcagagtaagtagtgggattccgttcttctaaaatgtttactgtttcaatttagataaaagtatctatctacaatattctgagagcaagcagaaaacttctaccctctcccccaaatgcccacaaccactatttaattcaaataaaatttagccaaagacagcccgggaagagatacgatatcctatatttgtggcctcggagcaaggtttagatgcgagcgcataaagcgagcatttaaaccgctgcgactaaagtcacaaatataggatatcgtatctcttcccgggcgtctgtctcttaatgaattaaatagtaactgttcacaatgatttcagagcaagcagagaacttctgctctttttgggaacgtcttatcttgcctgcggcaaacgcctatttaatcaaatcttcgaatgagacattgaaaagatcacatagagctttgatttctatatccgttacataccgttgttgcgtttcaattctagtaattacatttttacccatatcataaccagcaagctgtaattcatgagcaagtccacgctgggataaatgatattttttccttaaagcaattaaattagcaccgattagattctttttaccggtagccgtgaatggttttggcataatatctcaccttccgatcaaattttgtaatgcgtaatagcatattcatatggttttattttacaaaatttgataataatacacggtcgtaaaagtgagacaaagcggaaaaaatgagacaaattttatttaaatttaaatgtctctgctattccaagccatttctgatctttttcacttaaggtaagagatgtcccgtcttttaaatgatatccttttgcagtagcgcagccagaatattctccgacgagttctggccattcaataccgatttctgggtcgttccaggcaagtccgccttcgtctcccggatgatagaagtctgtacatttataacagaattctgctgtatcagacagaacaagaaatccgtgggcaaatccctctggaatatagaattgtttattattttctgcagaaagaatttcaccaaaccattttccatatgttccggagtggcttcgtaaatcaacaacaacatcaaaaacagtaccgttgattacacggacaagtttcccttgtgggtgctgtttctgaaaatgcaggccacgaaggactccttttgtggaggcagactgattgtcctgaacaaattccattgtaagtccggcttctgccatatcatttttattataggtttccataaaataaccgcgggaatcaccgtgaagggtaggttcgataatacataatccttcgattcctcccacgttcttttttactttaatctgtcccaagagagagacctcctttaattgaaaattcttttctattgtaatacttcttttaaatatctttgtaatgcatctttccaatctggtaaaggtgtaaatccagcctcgaccagtttacttttatccagtctgctgttaaatgggcgggctgctttggacatgccgtactcagcggttgtgacaggaaagacagtaacatgattttcatcgtattctgtatgtccaagtgcaactgcctgacggaagatttctttggtgaaatcgtaccagctgatataaccgccttcgtttgtggcgtggtagtagccgtatttttcgctttctgccatatcgacaaggagtcttgccaggtcaaaggtataagttggagttccaatctgatcattaactacggtaagtttatcgtgatttttgccgacagtaagcattgtcttgataaaatttttgccgttttgtccgaatacccaggcaatacggacgataaagtatttttctaaagtattagcgactgcctgctcgccaagaagcttggtttgaccatacacatttagtggtttatagtctttgcagtccggtttccacggtgtagttccctgaccatcaaaaacatagtctgtacttaaatagatcattttgcaatcaagttctttacaggcagaagcgatatactgtgtgccagcggcattgattttgcgtaccgtttcctgcttgtctgcgtcttcggcaaggtcaacagcagtccaggcagcacagtgaacgacaatgtctggtgctgtctcttttaaaatacgggttacagcttccttatctgtaatatctaatgaaatataaggcatttttgttacaggagaatcatcctgaatcccggaatattttggagcaatgtcagatccgattccctcgtaactgcgtgaggaaagctcattcattacgtcatgaccgagctgaccgttaacgcctgttacaaaaaatttcatggtataattcctcttttcatatatttacaaatttaaatatgaagtcaacaagaggatagatatctgttgttgacttcacaaataaagactttcgtttgtcatgggcgaaaattcactacccttaggtgatagtagttgacatgaaataggtgttcaaaataaataatattttttatgcaagagtgagaaaatcaactagcggtttttatacattttctcatagtaatcctgatattcgccggaaatgattgtttcccaccattccttattatcaagataccactgaattgtctttttaataccgtctgcaaattttgtttcaggaagccagccaagttcattgtgaattttagtagggtcgatagcgtaacgcatatcatgtccttttctgtcagcaacataagtgataagactttctggtttgccgagttctttacagataatttttacaatatcgatatttttcatttcgttatgtccgccgacattatagacttcaccaacacgtccgttatggatgattaaatcaatcgcgcggcagtgatcttcaacataaagccagtcacggacattttcccctttgccgtaaactgggagtggtttgtcatttaatgcatttgcgatcataagcggaattaatttctctgggaaatgatatgggccgtagttgttggagcaacggctgattgttacaggcagcccgtaagttctgtggtaggcgagaactaataaatcagcgccagctttagaactactgtaaggggaacttgtatggattggtgtttcttctgtaaagaaaagatctgggcggtctaatggcagatcaccgtaaacttcgtcagtacttacctgatgataacgcttgataccgtatttgcggcaggcatccatgaggacagcagtacctttgatattagtatctaggaaaacttccggattttcgatagaacggtcaacgtgactttccgcagcaaagtttacaaccatatctggatgttcttcttcaaacagtttgtatacagcgtctctgtccgtgatgctttcttttacaaagcggaagtttggattatccatcactggctctaaagtagaaagatttcctgcgtatgtcaggcagtctaaacaaatgattcggtaatccggatatttgtttaacatatgaaaaataaagttgcttccgataaatccggctccgccggttacaatgattgtcataagtagatactccttttaatataaattctcctgatattttccatctaaaacatcttttaaatactgaccgtattcgttcttcttgagaacttcgtagactttgagaacttcctctttagaaatccagccatttaagtaagcgatttcttcaaggcaggcaattttgcggtgctgatgctgttccattgtctttacaaagtttgttgcatcaacaaggctttcgtgtgttccggtatcaagccatgtaaagccctgtccgagaagctcaacatttaaagaattattttctaagtaaatgcggttcaaatcagtaatttctaattcgcctctggcacttggggtcagattctttgcatactctacaacacgattatcgtagaaatacagaccggttacacagtaattgctctttggatgcgatggcttttcttcgatagaaacagctttgccgttgcggtcaaattcaacaataccgaaacgttcagggtcatcaacataataaccgaaaactgttgcaccattgccattttccgcatttttaacagcggcacagagacgttttttcagtccatgtccggcaaaaatattatcgccaagaaccatagcaaccgtatcatcaccgataaattcttctccaataataaaagcctgggcaagtccgtccgggcttggctgtacagcataagataaattcacaccaaactgctttccatcttttaataactccttaaaacgaggagtatcctgtggtgtggaaataattaaaatatcacggatacctgcattcattaaaacagacatcggataataaatcatcggtttatcataaataggaagtaattgttttgaagttaccatggtaagaggataaagacgagtgccagaaccccctgctaaaataatacctttcataaaaactcctttcgtttgttgtaatcagaatctcgatattttaattataaaagatgcccttagggcaccttcaagtggtttttcttgctatttaattcattaagcaactaacagatgaagccaagaaagaaattatcaaatccaaatagcccccctctccgttgccgaattgggtgtgacaacattcgtatcatatcataaccgtaggatatataaaagataaaaaatattatcaaaaccgatactttctcggtgaaaccccatacttctttttgaagcacctattaaagtaagaaatattgttaaacccagtagcgaatgcaatatctagaatattatcggttgttgtagtgagtagttctgccgcaatttctaaacgatagtcattaagatactgaataaagcttactcccatagtttctttgaagaacttcataaagtaagatttgctgtaaaagcaataatttgcgatatcttcaatcgcaatgttttcctgaaaattgttggcgatataggataatatcgtctttatttttttgagagatttttggttgattggtttgattttattttgcccgcagtttgaaacgagagtatatagtatttgaaataaatgtgccttgatggacagttggtaagcataagggcgtaaatcacacaggtgatcgatttcgttaatggcggtgatgactggaggataatatggagtctggttattgattaccgggcagatattaaggctgcctgaaaaaagtggctgaatgaatttgtcattgcataagtcataaccggatgattttaaaaggctggatttgaatagaatattctcgtattccataatttcgttgtctttctggctgattgcgtggagctgtccggggagaacaaagataatgtctccggcactgacagaataggtggttaagtctacactgacaataccgcttcctttttttataacaatgatttcaacttcatcgtgccagtgaaggtttaccgactgaaaatctaaggggatggaacataagtaagtgttgtatggaaaatcgtctggagtatgtattttattttcgtgatatattttgtattgaagtttatccatttctatattttgcatgtcgaatttatgtattgaatctggagataaattcgagagtttcctttcttaataatatagataccaagcccgattagatatgtatacagggcgtatcgtatatatctcatacctgtaatactacatatctataaagttaaatatcaaaaaagatagtattgtacaataatataagactgtgctgcaataaatcagtatttaacagtattataatataatcacagtaaaaatacacgagaaacttttaaaaatgattttcgaaatttttttatgaggttatgtggaactttatgaagctatgtgaaatcagatgcaagagatttcgagaatacattatttttcagggaggtattacaatatgaaactttcagaatttgtaaaagcagagtatggtaaatccatttcagaatgtacaaatgaggagctttattatgcattgcttacattaacaaagaaaatggcttctggtaagcagcatggtaattctaagaaaaaattatattatatatccgcagaattcctgatcggaaaattattatcgaacaaccttatcaatcttgggatttatgatgaggtaaaggaagagcttgcacagaacggaaaagatatttgcgaaatcgaagaatttgaaaatgaaccttcacttggtaatggaggacttggacgattagcagcatgctttattgattctattgcgactttaggattaaatggagatggtgttggattgaattatcattttggactgttcagacagatttttgaaaataatatgcagacaacagtgccggatccatggcttacagagaaaagctggcttaccaaaacggatgtgacatatgacattaagtttaaagggatgacagtaaaatcaagaatgtatgatattgatgttattggatataataatacatcaaataaattgcatttgtttgatgtagagagcgtggatgaaagtattgtagaggatggaattaattttaataaggaagatattaaaaagaatcttactcttttcctttatccggatgacagtgatgaggcaggtcgtattcttagaatttatcagcagtactttatggtttccagtgcggcacagttaattcttgatgaatgtgttgcgaagggctgtaacttgcatgacctttctgattatgtagtgattcagattaatgatactcatccgacaatggttattccggaacttatccgtctgcttgtggaaagaggtcttgagatggatgaggcgattgaagtggtaacaaagagctgtgcttacacaaatcatacgatacttgcagaagcattagagaaatggccgatttattacctgaaaaaagcagtgccgcagcttatgccgatcatcgaagttttagatgataaagtaagaagaaaatatcataatcaggaagtgtatattattgatggagaagaaagagtacatatggctcatattgatattcattattcttccagtgtcaatggagtggcatctttacatacagagattcttaaaaacaatgagctgcatcatttttatgaaatttatccggagaagtttaataataagacaaatggtattacttttagaagatggctcttacactgtaatccacagttgacagaacttattacttctcttatcggggatggatttaagaaggatgcaacacagttagaaaagctgttagattataaaaatgatgaaaaagtattaaaacagcttcttgagataaagtctgctaagaaaatggaattaaagaaggcattgatggaaaaacagaatgttacgattaatgaaaattctatttttgatattcagattaagcgactgcatgagtacaagagacagcagttgaatgcgttgtatgtcattcataaatatttagagattaaggcaggaaagaaaccatctacaccgataactgttatttttggagcgaaggcagcgccggcatacataatcgctcaggatatcattcatcttatcctctgtctgcagcagcttattaataatgatccggaagtaagtccgtatcttaatgttgtgatggtggaaaattataatgtaacatgggcagaaaaattaattccagcctgcgatatttcagagcagatttcacttgcctctaaagaagcaagtggtacaggtaatatgaagtttatgcttaacggtgcgcttacattaggaacagaagatggagcgaatgttgagattcatgaactcgtaggtgatgataatatttatatttttggagattccagtgatacggttgttgaaagatacgcgcagggaagctatcatgcagcaaaatattataatgaaaatacagcgatcaaagaagctgtagacttcataacaggagaagaattaaaagcaattggcgataaagacagattagaaagattatttaatgaacttgtttctaaagactggtttatgactttccctgatttcgatgagtatgtaaagacaagagagcaggcatatgctgactatgaaaacagagaagaatgggtacagaaaatgcttgtgaatatcgcaaaagcaggatatttttcttctgatagaacgattgaagaatataacagagatatttggaaattagaggactagagagtgtttgaaaaggataaagttgctgtgcaatagcttaaatagccattgcacagcaattttattttagtagaattttcttgtttttgtacgaagattgtaataaaatggaaacaacgatttgcttactataatcatggaaccagcaattatagattttgattttatttcaaaaataaaatggaaaggagaagttcttgaacataaatgaaacattaaaacactactttggttacgacagtctgcgtccaggacaacaggaactgatagaaggaattctacaaagaaaggatgtccttggtattatgccaacaggtgcaggaaagtccctgtgttatcaggttccagcactgatgttagatggaattacgattgtagtttcaccgcttatttctctgatgacagaccaggtaaaggcgttaaatcaggccggtgtgcatgcggcgtatattaacagttctcttacggaaaaccagataaggactgcacttttctatgcagcgcagggaagatataagattatttatgtggcgccggagaggctgaatacgatacgatttctggagtttgcatgccaggtggatatttctatggtgacggtggatgaggcgcattgtatttcccagtggggacaggatttccgtccaagttatgttggaattgcggattttcttgcacagttaccaaagcgtccggttgtaagtgcatttactgcaacagcaacggaacgagtaaaacaggatattatgggaagtctgcgtttgcaaaatccagtgacagttgtgacaggatttgaccgaccgaatctgttctttcgcgtagtgacccgaaagggtggaaaagagaccgacaacagtgttcttaattatgtcaaaaagcatgaggatgagagtggaatcatttattgtgcaacgaagaaaaatgcagacaaaatatatggacttttgcagcagtatggcattgaggcagggcattatcacgcgggcttatccttagaggaacggaagaaaaatcaggacgattttacctatgaccgaattcgtgttatggtagcgacaaatgcatttggaatgggtattgataagtcaaatgtgcgatatgtgctgcattataatatgccacagagtcttgaatattattatcaggaggcagggcgtgctggtcgtgacggggaagaagcagagtgtgtattatttttttctaagcaggatatcatgataaataagcggcttttagaatataagagtacagaaagtatagagagtgacccgcaggtacggagaaacgattatcaaaagttaaatcggatgattgattactgcgaaacacaacagtgcctgcgccagtttattttgtcatatttcggggataacagtccatgtacctgcgataaatgtagtaattgtgtggttgtggaagatgaggaagaggaaaactacatccagaccaaaaaggaaaagaaaaaagcgttccagcttgccaatctgactccgaaagggcaggaattgttcgagcagcttcgtaagtgcaggacagaacttgctgcagaaaaaggagttccaccatatataatctgttccgataagacattaacagatatgtgtgcaaaatgtcctgtagacaatgaagatatggaaacagtgtacggaatgggtgtgcagaaaattcaaagttatggggaacattttaccaaaatcattatagactttttagaagaacagagtgcagccggtggagcagatgcagaaactctgcaattaacaacagagttaacaccagaacaaatagagaaaacaacaggaatgacagtagcagcctctcctgcaagaaaaaagaaactgccattttatatcgcaccgggaaaattagacgaagtggaactgaccgatacctgtatgatttcagaacttacgaaccggattaacgaactttgtgacgaagaagaccagaaaaaccgcaaaaaactaaccgcagcatttgtcaataccttactgatacaaaaaggatatattgaagaagcaacagaaggcgaagaaaaagtaaaacatataacagaaaaaggaaaagaagcagggatacaggaagaagaacgatatggcaaatatggaagaaagtattacgcattagtacatacgagggagagtcaggagatgattttgggagaactccgagagtatttggctgatttgacggatgagtgataaacagacgaactccagaagataaataaagcatattggtgactttagtcgcggcgtgttgaatgttcgctttcgcgctcacatccaacctgcagcgactaaagtcacaattctgaattctttccttccctgagggcgtctcccttgcctgcggcaattcagaattttccacccgacttgtaatattccacacacaaaataatgatatttaaatataatttgataaaaaaagcactattagcaaaaactttctaccgctaatggtgtttttttgttttctttttacgaaaactatctttagtgaaaaagcgattcatggtataatcgaacgaggcagaaagtgatggtttttgaatgtcatgttctgaaggttacgaaaaatacaaaaaataggtaaaaacagtattgttttaaggaggataacgtgttaaatacaacaaaatcagaagagttatataaagtagcacttgacctgatgccgggtggtgtaaactcaccggtcagagcatttggtgctgtgggaaggaaccctttatttattgaccatgcaaagggttcctatgtttatgatgtggatggtaataagtttattgactatgtttgttcctggggacctggaattcttggacattctcatccagaggttcttgaagaagtagtgaaggcatgttttgacggtcttacttttggtgcgccaactggtaaggagaatgaactggcacagcttgtcaaagattgcgtaccatctatggaaatgatgcgtatggtaagttcaggaactgaggcaacgatgagtgcgattcgtgcggcaagaggatttaccggaagagataagatcattaagtttaagggatgttatcatggacattctgatggattattagtgcaggctggttctgcagcattaacacagtctgtaccggacagcagcggagttcctgcttcttttgcacagcagactttagttgctctttataatgataaggattctgtaagagagttatttgagaataataaagaccagattgcagctcttattgtggagccagttgcagcaaatatgggtgttgttattcctgacgatgattttcttcctttccttcgtgagattacagaagagaatggaacaattcttatttttgacgaggttatcacaggattccgtcttggtgtcggcggtgcacaggagtggtttggaattaagccagatttatctactttcggaaagattgtcggcggtggaatgccaatggctatctatggcggacgtaaggatattatgagaaatatttccccgacaggaaaggtttatcaggcaggaaccttatctggtaatccgattgcgacaacagccggaatcaagactcttgaaattttaagagaccatccagaactttatacaaagattgaagagaatacaaagaagcttgcggaagcttacaaagtaagagcgaagaaacaaggtatcaatattcatgttaaccagatcggttctcttatgagcgctttctttacaggggaaaatgtaaaagattacacaggagcaacatcttctgatactaaggcttacgcagattactttaactatatgttagagaatggtatctatgtggcaccttcacagtttgaggcgatgtttatttctgcagctcattctgatgaggatattcagagaactattgatgtgcttacaaaataggaaagatattaaataaaagatattatacttattcagagtaattgcaaatagaaataatttataaataagaagtctgtattggaaacaggggcgaaattttaaaaataaaacaagtctcaaaacatatttataaaaatgaatataactataaatatagtaaataagacagaaagtcaaaggagaaaaaatggtacattttattggagcgggtcctggagacccagagttactgacaattaagggaaagaaattaatcgatcaggcagatgtaattatctatgctggttctttagtaaataaggaagttcttgccggagccaaagaaggcgcagagatttacaacagtgcgacaatgactttagaggaagttattgaagtaatgaaaaaggctgaagctgaaggcaagatgacagctcgtgttcatacaggagaccctgccgttttcggtgcacacagagagcagatggacgagctttcccgtcttggaattgattatgatgtcattccaggtgtgagttctttccttgcaactgcggcagctttaaagaaagaatatactttaccgggagtttcccagacagttattcttacaagaatggaaggcagaacaccaatgccgccaaaggaaaaattaagagatttagcaaaacataattctacaatgattattttcttaagtgtaggaatgattgaacagcttgcagatactttaaaagaagagtacagagaggatacaccagttgctgttgtatacaaagcttcctgggaagatcagaagattgttatcggcaatctgacaaatatcgcacagaaagtaaaagaggcaggaatcacaaagacggctcttacagttgtaggcgattttcttggagacgagtatgaactttctaaactttatgacaagacatttacacacgaattcagacaggcaaaagagtaagccgtgtggttttgctggaggcagaaaataagaaatgggtatacagataattagtatcagtcataaaatcgcacctcttcatgtaagggaaatgtttgcatttacagaggagcagcaaaaacatatgatgcaggagatcacagagcatttggaagtttcagaatgtatcgtgttatctacctgcaaccggacggaaatgtatgtgtattctgattcggaaagcaagggatgtgtatttaatctgatggaagatgtactgcttggcgaggcaggcgcacaggatgaagaagatatcggaaattatcttttattttatcatggaaaaaaggcgattcatcatctgtttcaggtagcggcagggcttgattccatggtaattggagaagaccagattctcggtcaggtaaagaccgcacataagcaggcaagagaggctggaacaacgggagtgtatctgaatacatttttccgtatggcagttacaggagcaaagaaagtaaagaccgaaacagaactttcaaaaacttctgtatcaacagcgacacttgcactgaaagtagccgaagaagaacttggaactttaaaagataaaaaggttcttatcattggtgcgacaggtaagattggcggtattgttctgatgaatattcaatctcttcatcaggcagatatttatgttacgacgcgtaagaataagctcatccagacaaagcatggaaatgacgagtttacgacaattgattatgaagatcgttatgaatatttagatcagatggatgtcgttataagtgcgacatcgagtccgcattacacactgacatatagcaagatgaaaaagcagcttacgacagcgaagcgaagagtctttgtcgatttggctgtgccgatggatatcgaagcaaaaatcagtgcggtggacgatacctgctactataatattgatgattttacaagaatcgcaagggagaataaccagaagaaactgagagaagcagaggccgcatcagggattcttgatgagtatgaacttcagtttgaacagtggatggtattccagaagtctttatccgttatgggaaaggtcagagataactttgtaaaagtagcagagcataaaggtgtggaaaaggcatttgaccatttcttctattgggtgagagagaataacacaccggaagatttggaaacatttttccagtgcctggatcattaaaaacagaccagaatatcggttttagaaggagaaaacaatgggtaaattatatgcagttgggttcggtccaggtggatatgaacacatgacagcaaaagcaattgatgtaattaaaaatgcagacatcattacaggatacactacatatgtagagatgttaaagaagtttttcccagagaaagagtacgtggcaacaccgatgacaaaagagatggatcgctgccgtatggcagttgatttagctgccgaagggaagacagttgcaatggtaagttccggagacagcggaatttacggaatggcaggaattcttttagagattgccaatgagaaaaaggcagatgttgagattgagactgttccaggtgtgacagcagcgagtgcagcggcatctattcttggagcaccgttaatgcacgattttacgattattagtttaagtgatctgatgacaccttactctcttattatgaagagagtggattgtgcaggacagggtgattttatcgtatgtctctataatccaaagagcaaaaagagagcggattatgtagaaaaggctgcagaaattcttatgaaatatcgtgacggcaagactccagttggtgttgttcgccatgcgggcagagaagaggaatcttcctatattacaacacttgatgcagtaaaagatgcaccgatcgatatgttcagtatcgttattgtcggcaattccaacacatatgtacgcgatggtaagatgattaccccaagaggatatgaagacaaatacggattcgcgaatgtagaataagatgagtatgtaagcgttttttttgcttacaaacttattatacgagtggaggaataagatgaaaaatatcatcaaaatcggaacgagaaagagtaagttagctctgattcagaccgatattgtaaaagataaaattaaaaaagcttttcctgaaatagaagtggaaatcgtaaagattgacacaaagggagatcagattcttgataaatcccttacttcatttggtggaaaaggtgtatttactgctgaacttgaagccgaacttctttctggtgcagtagatattgcggttcacagtgcaaaggatatgccgatggatttcccggaagggcttggaatcggtgcagtccttgacagagcggatgtgagagatacttttgttactacaactggtaaaaaattagaagaattagagccaggaagcattgtcggaacaagttctcttcgaagagaattattaattaaagaaattaatccctatgtaacgattaagcttctccgtggaaatgtacagactcgtttaagtaaacttcgtgacggtcagtatgacggaattattcttgcggcggcaggaatcgaaagacttggatatgaaaaggaagagggacttcactatcagtatcttgacccggatgtatttcttccggccgcaggtcagggaatccttgcagtagaaagccgcgtagaagatgcagagatggcagaaatccttgcggcgatccacagtgaaaaagcagaatgtcttttaatggcagagagagcatttttaaagacaatcggtggaagctgtaacgcaccggcggcagcactttgtcgtgaggaaaatggtgaattttccatgcgtgccatgtatgtgaaagatggaattcatagcagaaagacgtatatgacagtgaatatagaagatgctatagcggaaaaagatgcagacagcaagccgatagctgggacggctgtggcagcagccgtttctgtcgaagaagctgttaaaacagacaaagagataacagagaaagatacggcaagaaaaagtaaagtagaaatagcagcagaacttggtatcagcgttgctcatgaagtaaacaaaggcatggtatatcttgtcggtgcaggtcctggtgatgaggatttgatgacgagaaaaggacttaagcttttaagagaggcagatgtcgttgtatacgataaccttgcatccagttcccttttaaatgaagtgagagatgacgcagaacttatttacgcaggaaagcgttcttcaaatcatcatttaaaacagtatgagacaaacgagcttttagtgaagcttgcattagaaggaaaaaatgttgtccgcttaaagggcggtgacccatatatcttcggccgtggcggtgaagaaggacaggaacttagagaagctggtgttgactttgaagttgtaccgggaatttcttcttcttattctgttccggcatactgcggtattccagtgacacatcgtgatttcgcatcttctttccatgtgattaccggtcatgaaggcaatcataaaaatggtgtgagtgtattaaattacgagacacttgcgaaagaagaaggaacattgattttccttatgggactcaaaaatcttcctaatattgtagcttcgcttattgagaatggtaaagatcctgcgactccggtcggtgtgcttcaggagggaacaaccgcaagacagcgtgttgcaacaggaacacttgctgatattgtagaagttgtaaagcgcgagggaattaagactcctgccattacagttgtaggtgatgttgtaagtttacgtcaggtacttgactggtacggacacaaacctttatccggcaagagtgttcttgtgacaggaacaacttctatggtagaccgactttctccgattctgaaagaggagggagcagaggccatttcctttagcttaatccgtactgaaagaatgaaacttccagagctggatgtcgcattgaaggaaatagataagtataactggattgtatttaccagtgcaaacggtgtggaatgtttctttgaggaaatgcaggaaatccgaaaagatatcagagatttagcgcatgtccgcttcgctgttattggagacggaacgaaaaaggcattggaagaacatggaattttctgtgattttattccgacagcatattcttcaaaagatatggcagaggcgatggttcctcatatcggaaaagatgaaagtgttcttctccttcgtgcagaggaagcaaacagagtgcttccagatgcattagaagaagctggaatttcccacacatgcatttctctttatcataccgtaacggatgagagaaaagcagatgaattgaatcgtttgattaagatggctgactatgtaacatttgcaagttccagtgcagttcgagcctttgtatctatggtagataatcttgacgaggtcaaaggaaaatatatcagtattggcccggttacaacaaagactgcacaggaaaatggtctctccattgcaaaaactgctgttgtatatacagcaagaggtatggtagaaacaatgattcaggatgcagtggaagaaggtcagaaataaatgaaaactcagataaaacgttttttgttaacacttggctttatgacaaggattcctgtcaatgtagatcttggcgaagtaaaagatgaagacatgcacaaaggatttttatattatccggtagtcggtctgattctcggactttgtgacatggcagtatttcttcttgtaagtcttattttaccagaagtatttggaatcctttttgcaatgcttgcgaacctctgtctgacaggagcctttcacttagacggtctttcggataccgcagacggaatctactctgcaagaacgagagaacgtatgcttgaaatcatgaaagacagccgcatcggaacaaacggtgcggtagcgatgtgctttgatctggcattaaagtttgccggaatttactacagcgatataagatggctgatgattcttcttatgccaatcgccggaaaaatggtacagggagcgattgtgtataaagcaatttatcctcgtgaaaaaggaatcggtatttatgtaggaactgtcagtcttggaacagtaatcggaaccgtcattcttggacttatcgcaatggtacttgccttctcctgctggggagtccttatctttgcgattctctttggattcgcttaccttttccgtgtatatatcacagggaaaatcggtggaatcaccggagatgttatgggagcaggaaacgagcttgcggaagtattattactgcttgttgttattgttcttacaaagtatacaggaatgacaccattatcattatttccattttagtttttaaaaatgagataatgatgaaggaaagttgtagaaaaaactattgatatttatttatatatgaaagtagaaaaatataaatttatgaagtggaagcaagactatacaaaaatatgaacaatatatgttggtattaaagtagcagaagggaagatggttatgactctggaggaagcaatcaaaaaaattcagccgctggatgaggaggcaatggagtacactcgtgcaagatggaatactcttgggaagcctcttcacagtctgggaagactcgaagaaatggtgacacagttcgctggaatttaccgcgataagaatccgcatttaaggaaaaaagcggttattgtcatggcagcagataacggtgttgtagcggaaggagttacccagacagggcaggaagtgacaaagacagtaacagaaaatatgacaaagcataatgcgacaatctgtattatgtcctccatgagtggagcagatgtgtatcccgtagatatcggaattgcaacggattgtgacaatccgggtgtttttccaagaaaaattaaatacggaacagacaacatggcaaaaggccctgcaatgtcgagagaagaagcggtaaaagcaattgaagtcggcatcggcatggtagctgatttaaaagaaaaaggctataacgttcttgctaccggagagatgggtattggaaatactacgacaagcagtgctgtctgttctgttttacttgaccagagtgtagaaaaggtaaccggaaaaggtgctggtcttacaaacaaagatttagaacataagatagaagtcatcaggcagagtatcgcactcaataaagtaaatgcggacgacccgcttgatgtacttgctaaagtcggaggtcttgatattgccggaatggctggctgttatatcggtggtgcggcgctcaatattccagtatttattgacggatttatttcatccgtagcagcgttaattgcgattcgcttagtaccggaatgtgcgccatatcttttcccatcccactgttctaatgaacctgctggacgtatgatactggatgctatcggcaaacagccatatatctttgccaatatgtgccttggcgagggaaccggagcggttatgggatttacgattgcagattatgcatttaaagcatactgggaattaccaagctttgagcagacgaactttggaacttatgaagaattgaactaaatataaaatgcaggaggagaaatgttagataaaattcaaatcgtaaaacctgccgaaatcgaaaaaagaagtatggaaatcatcacaagcgaattaaacggaagaacctggccagagccggagttctctatcgtaaaaagatgtatccacacttctgcagattttgattatgcagataatttatgcttttctgaaaatgctgcgaatatcggtgtagaagctttaaaaaatggagcacatatcgtaaccgatacaagaatggcatggtcaggaatcaacaagaaaaagttagcatctttcggaggagaagctcattgcttcatgtctgatgatgatgtggcaaaagaagcaaaggaacgcggatgcacaagggcagctatctgcatggaaagaggagcggttttagcagaagagaaaaacattatttttgctattggaaatgcaccgacagctttaatccgtttatatgagctgattaaagaaggcaagttaaaaccagcgttgattatcggcgcaccagttggctttgtcaatgtagtagaatccaaagaactgattatggaagccggagttcctttcatcgttccaaaaggacgaaaaggcggcagcaacattgcggcaacgatttgtaacgcgatgttgtatcagttgtaaaaattattttctaaaaaatgaatttgaataaatcattttaagagattattttcatgaaaatatattggaattgaatttatgaaaaaactaagagaaggagtttccactggctcctgtatgaccggtggagcggaggcttccgtgatctggcagacaacgggtaaatgtccttcagtagtgaaggtggataccccaatcgggaaaacactttatcttgatattattccaagagagttcggagtctgcggcgtggtaaaagatgccggggatgatccggacgtaacaaatggaagcgagattgtcacaaaggttgagctgtttgaggaagagggagacatttcctttttcggaggagaaggagtcggcactatcacgcaggaaggattaaagattcctccgggacagccggcgattaatcccgttccccgccagatggcagaaaaggcaatccgaaagattatcggcaataaaaaggcaagtgtaacagtaagtattcccggtggaaaagaacttgccaaaaagacatttaatccaaggcttggaattgtagatggactttcagttcttgggacgacagggattgtccggccgatgagtgaggaagcgatgaaagattctctgattgcggaacttgatatgtatgcaaaacagggacataaaaccattctttttgtacttggaggaacgggagagaatgcattaaaagaacagtatggcgaatttcagtgcattttgcaggtaagcaattacatcggctttatgatagaagaagcggtggaaagaggctttactgatattttaatcggaggttttgtcggcaaacttgtaaaagtagcctcaggcacaatgaatacgcacagtcatgtggcagacgggcgaatcgaaactatctgtacccatgcagcacttcacggtgcaccgacttccgttatcaaaaagatttatgactgtctcacgacaaaggcagcaatgaagattgttgaagaagaaggcctgatggatatctggccggacatggcacagaaagcatcggagtattgcgagaaaaccgcccacaaaatggcgagagtaggcatcattttccttgatggacaaaatgaaattctggcggtgagcgagaatataaaagaagtactttcagcctgcaagaaatgattagtaatgtatagcttgaaataattgcagaaatcaaaaatgtaggcgaaatcagaaagaaaataattgcagaagtaaaataactgtggaggttagaatgagcaaattaaccgtagctggaatcggaccaggtgaagccgattacattttaccggcagtaattgaaaaaatgaaaaaagcccataccgtaattgcggcaaagcgagttttaccgattttagaagaattgtgccaggatgtcagtgattcagcgtctgtattgcagcatgattctatatcttttttcgcaatggggaaaattaaagacacgctagagcagattggaaaaattctttccgagggacatgatgttgtaatggcggtaagcggcgatccgcttatgtacagcctttatcgcacaatctgcaatgatccgatcagcgagaattgggatatggacattatccctggcgttggttccttacagatgctcggtgcagcattcggagaaacaatggaagatgcattgatcatcagtgtacatggaagagcgaaaacagcaggttctattgcacttgcggtaacagaacatccgaaagtatttttcctttgcagcaaagaacagggcccggcatggctttctcggattatgctggactatcagcttgatgatgtgactgtctgcgccggagcgaatctttcctacgaagatgaaatccttgcatccggcacacctgctgaaatggtaaaaaaagagttcccctctctttgtgtcgcaatgattaaaaatccatctccacgccagattgttcgtccatgttttttatcagatgaagattttgagcgagataaaacaccgatgaccaaagaagaaatccgcatactcattttacataaaatgaagttacatcctgatgatgttgtgtgggacgttggcgcaggaacaggttctgtatctatcgaatgtgcaagacaggttccatttggaacagtacacagcgtagagcgaagcgaaactgccgtaaaattaatttacaaaaacaaagaaaaattttcggcagataatttaaccgtctacgaaggggatgcggccgaaaccgtagcaaagctgcctgaacctgacaaagtatttatcggcggcagcggcaaagaaatgtctcagatattagagacaatcgcggcatttcctaaaaaaataaaagtagtcatttctgcggtaacaatcgaaactatcgcagaaaccaatgaacttttaggaaaatacgccccagacttcgatgtcattcaggcgacagtcggacggggaagaaaaatcggtagctatcatatcatggatacgaataatccagtaatgatattcacagcgtacatttaaaggctatatgataatgtataattatacagtgcagaatattttgcattgtagccatataatatattcaaaaaaatgaatgtgtaaaaatgtaacagtctgtttttgattgttatcagggaacaaacaggagagaaaaaatgggaaaaaaagcattattagtagtgagttttggaacaagctttgaggaagcacttccagcaatcgtcaacatcgaagaaacctgcaaaaaggcatttccggactatgacttttatcgagcatttacatctggaatgattatccgtaaatgggcaagaacaaaaaatgtcattatccataatccggatgaagtgatgaaacgactggtagcagaaggttacgaagaagtaatctgtcagccaacacatattataaatggactggaatatgacaaaatgatgaatatgcttttagcatataaagatcagattccaacaatcaaggttggaaacccccttcttaccgaagaggaagattacaaagaagcctgcgagatcgttatgcaggaattagaaaagccattagcgaaagacgaagcttttgtattcatgggacatggaacagaacactttgccaacagcgcatacagccagtttgaaaacatgctcagagaccttggacatgaaagcacatatgtcggaaccgtagaaggattccctggtcttgattacgttatccgtcgtttgaaaataagagatattaaaaaagtatatgttatgccccttatgatcgtagcaggcgatcatgcccgaaatgacctcgccggagccgaagccgactcctgggattccatcttaaaagcagacggatttgaaaccgaggttataatgaaaggtttaggggaaattgatgcgatagcagaaatgtttgtaaaacacctgaagaaggcggagtctttgtaaaatgattttagttccagaagggaagagtagacaatgattaactatacccaccaatagatttatatagacaggatttttgacgaagaaaaagaaagtagtttgagttggattatctgtagtgaaattttcaaatgaatataaaagaagatattttgtgactttgtgctgtggagttttgactgtagactcgcgagctcgttttcgagcgagtctgtactatcaggcacaacggaacgtttagcacaacggaacaaaaataacttcttttatattcatttgaaaattgggttcaaacataataactcaaacgattgctttttctttctcaaaatccgtctggaaaggaagattatgaaaggcaaattatatggaatcggagttggccctggtgatccagagcttttaactctgaaagcaaaaagattaattgaagaatgtgatattgttgcagtaccggtgaaaaaagaaggcgaagatagtgtcgctttaaatattgcaaaaggtgctgttaagattcctgaggaaaagattcaggaaatcgtatttacaatggcaaaagataagacaaagcgtgaggcttgccgtcaggcggctgccgaagaaattatgaagttacttgatgaaggaaaatcaatcgcgatgctcgcgcttggtgatattggaatttacagtacttatgcatatgttcataaacgtttgttgaaagaaggatatgatgtggaaatggtttccggtatcccatctttctgtgctggagcaagcaaggctggtatttctatcgtagagggaaatgaaggttttggtgtaataccatctctgaaaggaattgatcaggtagagaagactcttggtgtttttgataaccttgttattatgaaggttggaagtcatgtgaaagaagtgtatgatctattggttgaacgcggcatggagaataacgcattgattatcagcaatgttggaatggacggcgagtatgttggtccgctgattcctgaccgcgagtatggatatttcacaacaatgattattaaaagtgagatgtaattatgaaatataatgttttggtgattgccgggacaacagaatcaagacaggtgattgagaagctgcttggagagaatccaaatgaaaggattcttgccagtgtggctacggaacttggaaaggaaatgcttcttgaatatgacattgatgttcatgtaggaaggcttgatcaggatggttttctcgcacttcttaaggagaatccatgtgaaaagattattgatgcttcccatccatttgcaaagattgtatcggagacggtgaaaaaggtggcagagtcagcagatattccgtatgagcgatatgagagaacaaacctccaatatgattatgaaggcattgttcatgtaaaagatgtacaggaagcgattacccttttaaatgagttgaagggaaatgtttttcttacaacaggagtgaacacagcggcagcatatatgtccggtgtagaaaatggagcagagcgcctttttatccgtgtgcttgataatgtttcatctctggaaggatgtgcaaaagctggttatccagaggggcatgttttcgggaaaatgcctccttttacagttgaggataatgtgaggcttatcagggaaacagaggcagaagtacttgtttcgaaagacagtggaaaaacgggtggcgttgatgtgaaagtggaagcctgcaggcagacagggattaagatgattcttatcgacagacctaatgcgctctaatataaagaaagtaaaaagtcttgggaaagtgatatggaggtgtatcaatatatggaaaatgtgaaaccgatgccgcgagttttgattgcaggtgcaaatagcggttgtggaaaaaccagcattacctgtggtattttgaaggctcttgtgaaccgggaacttcatattcaatcctataaatgtgggccggattacattgaccctatgttgcacagtcatattacaggaaggaactgtcggaatctggacccatttttttctacaggagaggacttaaggtatcttgtaggaaaggatagccaggatgtggatttttctgtgacagaaggtgtcatgggttattatgatggtgttggtatcagttgtgagaaaagtacatggacagtttcaaaagagacgggaacaccgaccattttgatatttaatgtgaagggaatgtctcacacgatgattccacttataaaaggaatggtagaatatcaggacaatccgatagctggagttattttaaaccgatgcagtaagggaatgtatcagttgatgaagccggaaattgaagagaaacttggaatttctgttgtgggatattttccacaaaaagaaggaatttatatcggcagcaggcatttgggactgatgaccgcagcagagattgataatcttgacgagattttaagtcttcttggcgagacggcggaggagtgcattgaccttgatctacttttagaaatcggggaaaaggccgaacctcttacagcggtaaaaagaccggaagttccagcggaaaagcgggcgaaaatcgcggttgcgtgggataaggcattttgtttttattataaagaaaatttggagattttggagcagcttggagcggaactttgctattttagtccggtaaatgatgtgcagcttccagaggatacggatgggatttatcttggcggcggttatccggaaacgtatcgaaaggagctggcagagaatctttcgatgaaagaatctatttgtgaggcagcaaaagcaggcaagccgattattgcagagtgcggcggttttatgtatgtctgtaatcatttagtggaaacggatgacagttcgatggatatgcttggtctgattgataccgatgtgcatatgacaaagcgtctgtccatgcagtttggctatgtgacactaaatgcgctttgtgatactgcattttttaagaaaaatacgaatattcgcgcccatgagtttcactattcaaaggcagacaaaagaggcgattcctgcgagattaaaaagtattccggaaaatgctggaacggtctttatgtaaaagaaaatatcatggcaggatatccgcatttttattttcataactgcagggaagttgcagaacgatttgtagatatggcagagaaaatatcaaagaatttgagtatgtaaaaagcataagagaggaaacagaataatgagactgatttatgcgatgttactcggatttatactggatttaatctttggagacccacatgggctgattcatccagtacagattatcgggtggtttatcgataagttaaaaaaaggcatgcagcatatgatttacggctgcagctatgaagaagtgagagaaaaagaaatcgagagaaaagcaggagtagaaaagacagcaggtttcttcttaatgctttttattgtagcaggaacatttgccgttgtttatggaattttatatgtggcaaatctgattcatccggttcttcgcttctgtttagagacattttttatttatcagattcttgcgacaaagagtttaaaaacagaatctatgaaggtctataaaaagttaaaagagggagatcttatcggagcaagaaaggaagtttcttatctggttggacgtgatacagagaacctcgatgagagcgaagtggcaaaggcagatgtggaaactatcgcggaaaatacggcagacggtgttattgcgccaatgctttttatagcaatcggcggcgcaccgcttggttttgcatacaaggcagtcaatacgttagattcgatggttgcatataagaatgaagaattgataaacattgggtttttctctgcaaaaatggatgatatctgcaactttattccggcgagatttgccgcagtaatgctgatgatcgcctcacttattttacgttttgattttaagggagcagtgaaaatatttaaaagggatcgttttgcacatttaagcccgaacagtgcgcagaccgaggcagtagcggcaggtgcattgcagattcagcttgggggaacccacaattattttggaaaagcagtcgtgaaaccgacaataggggatgatatccgtccagtagagtatgaagatataaaaagaaccaatcagttattgtatgtcagcgcagttttatcgatggcggtatgttgtctgattacatttttgatttatgtgcagttattttaaatacttaatatataataaccaacgatttagaaaattgaggctaaagttatgaagaagatttcacacggaggaaacatttacaagaaagcgaaggagatggggattcgggaggaagatatcctggatttttccgcaaatatcagcccgcttggcttgccggaacatattcgcaaggcaatgatagaagcgattgatggaacaataaattatccagaccctgattgtagtcgtttaaaagaagccatcagtaagcaggataatgtaccagaaagtcatattacctgtggaaatggaggggctgaccttttataccgtctggcatttggtttacatccaaaaaaagtattgcttccggctccggcttttgtggagtatgaggaagcattgtccgcagcaggtgcacagatggagtactatcttatgcgtgatgattttgtaatcaaagaagatattttagagcagataacggaagaaacggattttgttgttatctgtaatccaaataatccgacaggaattcttacagagaaagaattgattcttcgtgttcttgaacgggcaaaagagacgaatacctttgtgatggctgatgaatgtttcttagaaatctgtcaaaatgagagtgaatatacagtaaagccttttatagaaaaatatgaaaaccttattattttaaagtcatttacaaagttatatgcgattccgggagtgcggcttggctacattcttgcaggaagtgaagatgtgattgcaaaggtaaatcgcaccggacaggcctggtcagtaagtcatattgcacagtgtgcgggtgtggcggcactttccgataatgtatacaaagaaagggtaatagagacggtggcagcggaactttcttatatgaagaaagagttttttaagctgccggttattttgtatgatggagcggcaaattatctgtttttccagacaccgggaattacggatttagatagacgattagaaagttatggaatcatgattcgaaactgcagcaattatgtgaatcttggaaaagattactggcgtgtggcggtaaaatctcatgaggaaaatgaaaaactcataaaagcattacggatgattttgaaaggggaagaataatggcaaaagcaattatgatacagggaacgatgtcgaattcaggaaaaacctttgttacagcgggactttgcagagtatttaaacaggatggatataaagtagctccttttaaatcccagaacatggcattgaattcttacattacaaaagagggactggaaattggacgcgcgcaggcaatgcaggcagaagcggcaatgatagagccgacacactggatgaatccaatccttttaaagccaacaagcagcatgggttcccaggttatcgtaaacggagaggtttatgataatttaagtgcgcaggaatattataaaatgaaagataatctcgcaccggaagtcatgaaggcatttaatcatctctccgaagaaaatgatattatcgttattgaaggggcaggttccccagccgaaatcaatcttgctgaaaatgatattgtaaatatgggaatggcaaaaatggcagatgcgccggttattcttgttgcagatattgacagaggaggcgtatttgcttccgcatatggaacgattaagttacttcctgtggaagatcaggagcgtttttgtggaattgtcatcaataaattcaggggtgatgtggatatcttaaaaccaggactggctatgcttgaagatttgacaggtaaaccggtacttggtgttattccaatggaaaaaattgatgtggacgatgaggatagtttatctgaccgcttgaatcagaaaacaattaccgagggaattgatgttgccgttatccgtcttcctcatatatctaactttaccgatttcagtgtttttgaattaattgatggagtttctcttcgttatgttaccgataaaaaagaacttggagacccagatctgattcttcttccgggaacaaaaaatacaatgggagatatggaatggcttatcgagagcggattagaaggtgcgattatccgcgcagcaagaacaacaagagttatcggaatctgtggaggattccagcttcttggtaaggaaatgcatgacccggacggagtagaacatggaggggatatgcgtggacttgggcttctcgataccaaaacaatatttaaagaagcgaagacaagaacgagaattcatggacatatttctgaagaacacaatatttataaccttgataatctatccgtagagggttatgagattcatatgggaacaacagaaaatcttggggaagcaattccaatgattactcttgaagatggaagaaccgatgcatatatgacaaaagacggccgtgtatggggaagttatctgcatggaatctttgataatgaggacctcgtatttgctcttgtgcaggatattatgaaagaaaagggaattaatcctgcagaaaatcatcttagtatagcggaatacaaagaaatacagtataataagctcgcagatttaattcgaaacagtctggatatggatgcaatttataaagtattatttggagagaagaaagagatggttcgttgcgctggaaaaaaagatgatacttctggaaaaggcttagttcatatttactgcggagacggcaaaggaaagacaacgaccagtgttggtttaacggtccgtgcagcaggaagcggcaagaaggttcttttctatcagttccttaaagataacagttccagcgaaagaaatattctcgaaaaagttcctgggatcactttagtaagaggaagagaaatgcagaagtttacattccagatgaatgagcaggaacttgacgaacttcgtatttataataatgaaatgttagacaagctttttgaaatggcgaaagactacgatatgttagttatggatgaaagtgtatatgcgataaaaagtaatcttcttgacgaggagaaattaatcacacatcttgaagaaaaaccagttggtttagaagttgttcttgcgggaagaaatccttcacagaaattaatggatcatgcagactatgtttccgagattcagaaagtaaaacatccatttgatcacggtgtaagttcccgtgtaggaatcgagctgtagcaatggcatattttccgatatttacacaaatcgatggaaaacgatgccttattgcaggcggtggaaaagttgcagcgagaaaggtatatacgctgcttcaatacggtgcagatgttgtagtaatggcagaaaaagtgtgtggagaaatcaaagaagttttacctgaggaaaatgtttttgaaggcgtttttaaatatattcataaaaatagatgtaataaaaatgaatgggatatagatgaaaataaatatgatacaggtggaaatatttctaatacagagttggaaaacactctcgataaaagatatagttctaatagtaatctaaaaaacatttcttatgatttggaaatctcagagaatttactggaaagtttatcagcagatttatcagaagatttattaaaaatcagaaaaaatatctttttagaaaaggaaattggcaaagcttttcttgttgtagcagccacaagtaatcgtgaggaaaaccatcatattgcagaactttgtcacgcttataatgtccttgtaaacgtagcagattctgaagaagaatccagtttcattttcccatcggttgtccgcaagggagatattagcattgggattaacagtgggacaggaagtccgaccgtatccaagcacattcgcaaacaaatagaaaaagctgttccggattattatgcagatattgcagtttttatggggaaactccgcgagtatgtaaaggcaaactttaaagaagaatcgcagcggcggtatattttaaaaacagcggcagcagaggcatttgcagaagaaagagttctcacccaaaaagaaatagaagaaataataaggcagggacaaaaatgattgaattagtagaagacaaattagacatagatacctatctcgaacttcgccagtccgttaattttagaaagttaacaagggatcaggcgaaaaagggacttagcaacagtatgtatacattagttgcatttaaagacggaaaggcagtcggcatgggcagaatcgtaggagatggagcgattatctgctatgtacaggacttgattattcgtccagaagtacagggcgaaggtatcggtggacttattttggagactttgaagaaatttgtcattcaggaaggctatgaaggaacaacaatgatgttcgacctgatgtgcgctaaaggaagagaagaattttataaaaagcatggatttattgccagaccaaccgaggacttaggtccggggatgattcagtttattcagattggggaagaggggtagagcgtgtttgaaaaatctcccgcaaattgtaatgcacatcttacagaaagcatttttcaaacacactccagtaaagttgctttttacattcagtgtggtaaaatataagcgttaaaattgtattttttgtagctatttgggattgtgtcattttactggatatatggcttaagattacagaagcaatatgttttgtgtttagtaaagttctggatagttgttatgttttaatagtatttatacagataggagaatatattatgattagaagaagacgtcttcgtgcaacagaaaacttacgtgcattagttcgcgaaacatcggtaagtgtatccgatttaatttacccattatttgttatcgaaggaaatgatatcaagaatccaattgattctatgccaggaatttatcagtattccctcgaccgtatagatgaggaattagaccgcattcgtgaggcaggagtaaagggagttcttttattcggaattcctgcacataaggacgaatgtggaacagaagcatacaacgaacatggaatcattcaggaagcaatccgctatattaaaaaagtatttcctgaattagttgtaatcgctgatatctgtctttgtgaatatacttctcacggacactgtggacttatcaaagatggtatcattttaaatgatgagacacttcctttacttgcaaaaactgccgtaacatgcgcccaggcaggagcagatatggtagcaccatctaatatgatggacggtcacatcgcagcaattcgtgaagctttagatgaggcaggatgcaagatgacaccaatcatggcttacagcgcaaaaatggcttccggatattatggaccattccgtgacgcagctcattctgcaccaggatttggcgatagaaaaacataccagatggattaccataatccaagagaagcaatgcgtgacattcaggatgacattgatgaaggagcagatatcatcattatcaaaccagcactcgccttcctggatattttaaaaacagcatcctgggaaacagacatgccactctgtgcatacaatgtaagcggcgaatactcaatggtaaaagctgctgctgcaaacggatggattgacgagaaaaaaatcgttatggaaaatatgatcggaatgaagagagccggagcgcagatgattattacatatcatgcacttgatgtggcaaaatggctgagagaagaatagagatttgctgcaggcaagggggatgccgctgtagagaatgaggttagtcggattgccagaagaagtattgagaagaaccactaaaaaatttattgattttgttccgttgtgctaaacgctccattttgcccaataaagcagaaacttcggaaaaagcagtccgaagtttctatggtcaaaattccgcagcacaaagtcacaaaattcaataaattttttagcggttcttttttcgtattttttgagcaatccgacaaaacttttacggcggctttttggatggagctagaattttattttgcctgcggcaaaatactattaacagaaaaaggaagatatgctttcagcgaccaacagccgaaaacattcttccttttcccgttatgcaaagtatagtgattaatcctattcagaatacatgaaatgaattaatctgactatattataatacatttttagaaaaaaagcgatagcaaattaaaaaaataatgcaaaaaggacagttttttatttgcttcagaaataagagacagtttgggtaatgtgaataaagtcatatatgataatacattctcaattagcttgataatgttgaaaaagattctcattaaggctatactagagttaattgctacttatatggaagtgttcaaaaatagagtttggatgttcatatgagatttatataatttatatatttatatagatagaagtaattaaaactaacgataactacaggaggaagaaatatgactttagcacaattacctgtgggaaaagaaggagttattgagacggtaggcggagagggaaatctgcgctgtcgttttttagatatgggccttattccagggacaaaagtgaaagtgcttaaaatggcaccgatgggagatcccatacagattcatcttcgcggatatgatattacgattcgaaaagaggatggagagaagatagtattaaaggagggatctgtccagtgatttttgctttaattggtaaccagaattgtggaaagacgacgctatttaatcagatgacaggttcgaatcagcatgttggtaattttcccggtgtaacagtagatcagaagatgggaaagtttactacagcttcagtggatgggacagtggtagatcttccgggaatttattctctccgtccctatacgaatgaggaaattgtcacaagagattttcttttgaaggagaaaccagacgggattattaatatagtggatgcaacaaatattgagagaaatttgtatttgacactgcagcttattgagatgaggattccgatggtacttgccttaaatatgatggatgaggtccgaaataatggtggttctattaatgtaaaagaaatgagccgtcttttagggattccgattattccgatcagtgcgattcggaatgaaggtgtgggagatttaatacatactgcttacgaagttgcggaaaataaacaatatccaaaagtctatgatttttgtacgccaggcccggtgcatcgctgtatacatggtttgtatcatcaattagaagaccatgccagccgaagcgggatgaatggacggtttgcagcggtgaaagtaattgagggtgatgaggatattattgaacgtctgaaactctcagaaaatgaacttgaaatgatggagcacagtattattgaaatggaaagagaccgtggacttgaccgtaatgcggcaatggcggacatgcgctatagctttattgaaaatatttgtgagcaatcagtagtgaaatgtcaggtcagcaaggaatatgagcgaagtgtgcagatagatagtgtgctcacaaaccgctatctggcattaccagtatttgcaggcattatggtatttattttctggatgacatttggcccgtttggttcatttttaagtgatgcattaagtgcaggaattgactgggtttcaagagaaatagaaatactactcacaaactatggaattaatccagtggtaaaaagtcttgtaattgatggaatatttacaggagtaggaagcgtactaagctttcttccagttattctgattctgtttttcttcttatctatattagaagatacaggatatatggcgagaattgcctttgttatggatacatttctccgtaaaattggtctttctggaagaagtttcgtaccgatgctgctcggatttggctgttctgtaccagcagtaatggcaagcagaactctttcttcagaaagagacaggaatctcacgatcatgcttattccatttataagctgttcggcaaaaataccaatctataccgtatttacagcagcatttttcccacatagaggcgtacttgttatgtcctgcctctactttggcggaatcgtaattggaattttgatggcattaattttcaaaaaggttttatttgccggaaagccaatgccgtttgtcatggaacttccgaattaccgttttccttctttaaaaagcgttttacttttaatgtgggaaaaggcaagggacttcttagaaagagcatttacgattatctttcttgcatcaatgattatctggtttctacagacatttgacagccggttaaatgttgtgacagacagtgcaaacagtctcctcgccatacttggccatttacttgcaccaatcttcaaaccacttggattcgcagactggagaatttctactgcccttgtaactggaatcacagcaaaagaagcagtagtatccacactcagcgtattattaggaaccaatgcagcccatgtatctgccgccctcggtactttatttaccgttcgttctgcagtaagtttcctcgttttcacactattgtatacaccttgcgtagcagcaattgccgccattaaacaggaaatgcattctacgttgaaaacgataggaattgtcatcatgcagtgtggcgtggcctggctcacagcatggctggtatatattggttctggagtgattttgtaagtgtaagacagacgaaaccgaagaaggaagccaccaaaagaatcatataacctttatctgtgacctcagagcaagtgttggatgcgagcgcatggagcgaacgttcaacataccgcgactaatggcacagataaaggttatatgatttttttttgagcgtctgcttgataaattaagaaaatttatgtttacttcttatagtggataagataaaatagggataaacacacagatggaaatattctactgtgaagaaaggtggtggaagtatgactgtaatgtattggctaggagccgcagcaatctttgttgtaattgagattatcacaatgggtctcacaacaatatggtttgccggtggagctttagtaggtgcagtgatggctgctttttccctgccattatggagtcagattatcgcatttgtgattgtgtcagtaattcttcttattctgacaagaccgtgggcattgaagtaccttaacagcagaacggttcggacgaatgcagacagtctgatcggacagacagcacttgtaacgcaggacattgataacctcaatgcgaaggggcaggtgaaagtcgaaggacagatatggacagcgagaagtatttccgatgatgtacagcttcatgaaggacagaaggtcatgatagaatctatttccggagtgaaggtaattgtaaaaccgatttaaaaatatactcttggaatttttctgtatttgattttgtaagaagaatccaagagtatataaggaaaaacaggaggtgtaacaagtatggctggaactatttttatgattatcattatattgttaatcgtgtatatcgtaacatcctgcgtgagaatcgtaccgcaggcacaggcatatgttattgagagacttggtgcatataatggaacatggtccgttggaatgcattttaaagtgccatttattgaccgtgttgcaaagaaagttctcttaaaagagcaggttgtagactttgcaccacagccggttatcacaaaggataatgtaacaatgcgtattgatactgttgtatattaccagattacagatcctaagctttatgcttacggtgtagataatccgattatggcgattgagaatctgacagcaacaacattgcgtaatattattggtgatctggaacttgattccactctgacatcccgtgagactattaatacaaaaatgcgtgcgacattagatgaagctacagatccatggggaatcaaggtaaatcgtgtggaacttaagaacattattccaccgacagagattcagaatgcgatggagaagcagatgaaggcagagcgtgaacgtcgtgaagctattcttcgggcagaaggagagaagaagtcttctattcttcgagcagagggtcataaagagtccatgattcttgaagcggaagcagaaaaagaagcagcgatccttaatgcggaagcgaaaaaggaagcgacaatccgtgaagcagaaggtcaggcagaagcgattcttaaagtacagagagcaactgcagacggtcttagagccatcagagaagccggagcagatgaagcagttatcaagttgaaatctctagaagcatttgagaaggcagcagatggaaaggcaacaaagattattattccttctgagattcagaatcttgcaggcctcgttacttctattaaagaagtagcagcacagccagaggcagtagaaaaagtagataccaccgcgaagtagagtgtgcagattgcagaaatgatttttcaaacacgctttaaggcagaagccggatgatataaaagtactatcagagaaatctcatcaggagttttgagtttgttccagaactttgatgagattttcttattttaaaaaattgggaaaaactatgaaaacaataatcaaaaagctactggctcactactggttagtgtatccagtattaattttaaagatgtttatatattattggcagacgaagcggctggatatgcttggtatttatgatgtgccattattaagtctgttatttttattttgtgtatttgaggcattttcttttaaagaaagtaaacccagacgatatggattttatattgtatacacattaattacgttaattatgatggcagatgcagcgtatagcagctattttggaaaatatgtatctgtcaaccagctttatcagattacaagccttggacagattgcaggagatggagatgtgattggagcgagtgtaagtccgtggtgtttactgactttgattgactatccttttgttttatattggtatcgcctgcgcaataaaggtaaaaaaggaatgcttgatgaactggcaaagtgctggccggaaaagtttcattttaaaaatgtgtggaaagaaaagaaatttatgttatctctgataaagagtgcattgcatatcattatttacattgtggcaatctgtgcgtggtattactatggattgaatccacagaatcttcgctcagttcagcaggtaaaccacattgaattttttacctaccatacgaatgatatagtagtaaatgtagtcggcaagttaaaaagaagttctgttgacgagaaagccattcaaaagaagatgaagagcattgtgccaaagtcatctgggacagcctataaaggtgtggcaaagggaaagaatctgatattgatacagacagaatcttttaataactttgttattggggcaacatataacggtcaggaaattaccccgaatctgaataaattattgaaaaaggatactatttatttcaaccatttttattcaacaaccggtgtgggaaatacatgtgatgcagaattttcagcgttaaacagtttatatccgaatgacatcagagagtgttaccgaatgtatgtggataatacatataacggtcttccatggatgttccgggaaaagggatacagtgcaatggcgtttcatggttatgtaaagacgttctggaatcgaagcgaggcatacaagaatcaggggttccagcattattattcggaagaagaactgaaacagactcagatttctggctttggaattaccgacaaggagatgttccgccaggcagttgatatcttaaaaacaaagcaacagccatttttcagctttatgattacactcacaaaccatattccatatgaattggatcagtcgctggcaagccttaaactaaaagacagtgatgtgggaagtacttttggtaattaccttcagaccgtcagatatacggatgaatcctttggaaagctgatagaatatctcaaaaaaaatgatatgtacgataatacagtaatcgctatttacggcgatcatcagggaatgaataaagaaaccccgtccgttcaatggaaaatgacagatttcctcggaaaagaatacgactatgatgagatgctgaatgttccgttcatcattcatattccaggattaaatgaaagtaaggtagcagacactgttggtggcgaagtagacattatgccaacaattgcaaatcttatggatttagatacaaaacagccctatgtattcggacatgatttattgaatgcagacgagggatttgtagctcagatatcctatgtaggagaaggctcctttatcacaagcgatgataacatgctatttacaataggaaaagacggaactgtagcaagtgggcgtttaatgtctctcctggatggcagccggaaaaatatcaacgaaaaactctgccagaaatattccgaccgtgctcagagtcttatagacacttgcaaggaggtgctggataataatctgatagctaattatataacacattagatttactatttaattcattaagagacagacgcccgggaagagagaagatatcctatatttgtgactttagtcgcggcggtttaaatgctcgctttatgcgctcacatctaaaccttgctccgaggccacaaatataggatatcttctctcttcccgggctgtcttttgtttgaattaaatagtggttacggggatttgggggagagagtagaaattttctgcttgctctgaaattattgtgaacagatgctttacatttaaattgaagttataaaggttgaaaagggaaattgaagcttacttcttcttgatccaatataatatagtcaagtcaaatcatccccctattcccagtcattctcgagtaagtagaagacatcgacttctgtcccccaaatcctcccactttctatttaattcatcctctccagccacagtacagaagccagtgaacttcataagccatatttgtggtctcggagcaagtgttggatgcgagcgcgtggagcgaacattcagcatgcagcgactaaaagcacaaatatggcttatgaagttcactggtttcgtctgtagtttgtctaatgaattaaatagtgattcttgacattattcttgacatgtagtataaattttgttaatacttttactatgtaagcaatatttataagcagtaattgctttgatctggaggaataaaagatggatttaaaaggacgcagttttttaactttacttgattttaataaagaagagattcgttacatgctggatttagcgcatgaactgaaagctaagaagaagaaaggtattcttggagaagaactgaaaggtaagaatatcgttcttgtctttgataaatcttctacaagaacacgctgttcttttgaagttgcagcgatggatgagggagcacatgtaacttatcttacaaactctcatatgaataaaaaggaatctattgaagatactgctaaggttttcggaagaatgtatgatgcaatcgagtatcgtggatttggacaggatatcgtagaagatttacagaagtactctggtgttcctgtatggaatggccttacagatgtagatcaccctacacaggttttagcagacttcctgacaatggaagagcatattgataagaagttagatgagatgaagcttacttttgtaggtgatttatctgataatgtaatgtatgctctgatgtatggaagtgctatcatgggtgttgactttaaggcagtaggaccagaagagacagtatgtgaccctaaggttcttgaagtatcacaggaacttgctaagaaaagcggagctacaattactatttcccatgatccagaagatgtaaaaggttctgatgttatttatacagatatctgggtaagtatgggtgagtccgaggaattatatccagtgcgtgtaaaagcgttatctccatataaagtaactacaaagatgatgaaggacacaggcaatgacaagtgtctgtttatgcactgtctgccatcttaccatgattttgagacaagtgtggcaaaggatatgagagaccgtcttggtcttgatatcagagaagtagaagatgaagtattccgttcagagaattcagttgtatttgatgaggcagagaacagaatgcatacaatcaaggctgtaatggtggcaactctcggaagatagtttatccggaaagacggtttaataatgaaagaaaagattttagaatttctaaagcagcaggagggatttatctccggtcagcgcatctgtgacgagctgggtatatcaagaactgctgtgtggaagtatatgaacagtctgaaaaaagaaggatatgagatagagtcggtgacccgaaagggttatcggcttttacaaagtccagacctgcttacgagggaagcagtgctttcctgtataaaaaagggagaaataccaggtgagttatgctgctttgaaagcattgattctacgaatgaggaggcaaaacgtcgtggagaagctggtgcgccagatggaagtatctatgtggcagacaatcagactaacggtaaaggccgaagaggaagaacatggctgtctccatctggggaggatatttttttcacgatattactgagaccagatctgcctttaaatagtgtatctatgcttactttagtagcggcttctgctgtggcggaagcagttgataaggttacaggacaggagtgtcagattaaatggccgaatgatattgttcttaatcggaagaaagtctgcggtattctcacagaaatgaacatggaaattgacagtattgcttatgttgttgttggtgttggaattaatgtcaaccgaatggaatttagggaagatattgcggaaacggcaacttctctaaaaaaggaaagtggtcatagtatagaaagagctgaattactttcggaaattctttctgcttttttcagagattataaactgtttttagaaaagcaggatttatcaccatttttggaaagttataatcagaagcttgtgaatgtaggacgggaagtaaagattataaaaaagggtgaggaaataattcgtacagccattggaattaacgacagaggcgagctgatcgttcaggatgccgagggaaatacagagcatattttttctggagaggtatctgtccgcggtatttacggatatgtataggaggccgttattatgtttgatgataaagtgatattatgtggttcaagcagttatgaaaagattttttactttaatccggagtttgattcacttccaaagcagataaaggatgaactccagattatgtgtgttctttttacagaagatgtaggcggaattctccgcttagaatttgatgaaaagggaaatcttaatcttactgtggaatcaaaggaagatgatttcttctttgacgaaataggaagtgttcttaagataaagcagcttcgtgcagaaaagagagagcttctggagaatatggaaacatatttcagagtatttttcttacaggagggacaagatgttattagcgattgatattggaaatacagattttacgataggagtctttcaggggaaaaagctgtgtgatacctttcggatgagaacaaagattaaccgtacttctgatgaatatggtgtgtttatattaaatactcttcagtacaaaggatatgacacaaaggatgtggaagatgtaattattgcatctgttgttccggctgtaatgcattcatttaacagtgcaattattaaatattttggattaactccgattattgttgggccgggaatccgcacaggaatccgtattgcgacaacaaatccgaaagaaacaggtgcagaccgcattgtagatgccgttgcaggatatgagctttatggaggaccggttattgtcgttgattttggaacagcaacaacatatgacctggttacagaagatggaagatttgtcggaggtgtaacttctccgggaatccgtacttctgcgaatgctctttggcagcaggcagcaaagcttcctgaaatcgaaatcagaaagccgcagtatattctggcaaaagatacggtaacaagtatgcaaggtggtcttgtttatggttacattggacagactgaatacattattcgtaaaatgaaagaagagagcggtttgggaaagattaatgtagtagctacaggcggtcttggaaaaatgatcgcgcaggaaacaagctttatcaattattatgatgcaaatcttactttaaaggggctgcagattatttatgataagcagaagcagggttaagtaatgacggttaaagagatatatggaacagattttccaataattctcgcaccgatggcgggcattacagatttgccttttcgtattctttgtaaagaacagggagcggatgttatggtcacagaaatgattagtgccaaagctcttttttatgggaataagaacacattgccccttatgcagacagaagaggaagaaaagccaatcggcgtacagatttttggatcggaaccggaattaatgggcgagatggctcataaaatcgaagataagggattttcttatattgatatcaatatgggatgccctgttcctaagattgtaaataataaagaaggctctgccttaatgctgaatccggaacttgccggccgaatcgtaaaagaggtttctaaagcagtgagtctgccggttaccgtaaagtttagaaaaggctttgatgctgatcatatcaatgcgccggaatttgctcagattatggaagaaaatggtgcagcggcagttgccgttcacggaaggacaagagtccaatattatacaggacaggcagactgggacattattcgtgatgtaaaaaatgcagtctctattccggttatcggtaacggtgatatttttaaaggggaagatgctgtaaagatgcgggactataccggctgtgacgggatcatggttgccagaggtgcaaagggaaatccgtggattttccgggaagtgaaagcagcactttccgggaagccaatcccagaacgcccgacagaggaagaagtgatttccatgcttcttcgtcatgcacagttaagcgtccagtataaaggcgaaaaaatgggaatccgcgagatgcgaaagcacacagcctggtataccacagggatgcatggttcctcaactcttcgcaataaagtcaatcaggtagagacttttgacgcattgcaggaactgctgatgcgttgacaacgaaaattttttggattataatggtgctttaagtgaagcagaaaagaaaggtgtagattatggtggaagcaaaaaaacatatccttacaagtcagggaatgcaggcattagaagatgagctgcaggatttaaaagtagttaaaagaaaagaaatcgcacagaagataaaagaagccagagaacagggtgacttatccgagaatgcagagtatgatgcagccaaagatgagcagcgttctatggaagcaagaatcgaagaacttgagaagatcatcaagaacgctgaagttattgatgagtccgcttacgataaagatacagtaagtatcggaagcacagttaagttctacgatgaagaatttgatgaagagcttgaataccgtatcgttggttctacagagtcagatatccttaaaggattaatttctaatgaatccccattaggaaaaggattaatcggtgctaagattggtgagacagttcaggtagaaagcccagacggattctctcgctacaaaattcttggaatctccagagagtaagaagtaaaattctggtttgccgcaggcaagggagaagaacaccaagaataaaataagccatatttgtgactttagtcgcggcatgttgaatgttcgcttagacgctcgcatccaacacttgctcctaggccacaaatatggcttattttattctcaggtggcgtctccttcgctgtgcaaaacagaatttacatcgtcaaaacttcatgttatactaaaaaagattgaagaaattttatttagaaatcgaggagcatctatgattgatccgaaaaaggtccgtttaatgaccaagttagcggtttatgaagaaggtcccggaaagaaagacttaaagattaactgctatagcaagagaacctatgtaaatattaaacagttagagagtataattgcaataacagtggcttatttattaggtcttgggttgtattgctttggaatatacacagatattatttcacagggattgaagttcccttatcagaaatatattcttcatgcgatgattctttatctgataataatcattattgattttgtatgtacaagaaggtattatacgaaggtttacgataagatgagagaggatataaagcagtacgactataatctgtatcgtcttgcaaggtatattcaaaaggaagagaaggacagggcataattttatgatggcacaaatagtctattttaaagaatggttaattgttttttataaaaaacatgtagatgtggttttgccagtactaaagctggtatttgccttttttactatgtgtatgtttcagggaatgtttccttataatatggtaataaacaaaccagggatttttctggtactttctgccgcgcaggcatttttaccgatatcagttttatattatatgatatctatattaattatgataaatttatggaaagtgtctatggatatttttctgggatttgttattttttctatcatatgttcactggcatttgtgagagtagatagaaaacacgcagtaattcttatagtaactgcggtaatgttttatttaaaattagaatatcttcttccggttttgcttggaatgattgtcggatttggggcgattcttccagcagcggcaggagtggtagtttattttctgtctgtttatatgacggatgtaagcacgctgcttaccacatcatcgagttctaattttggaatgggtctgcaaagaattgtaaatttgatgttgattgataaaaagctgcttgtatttttgattacatttagtttaattatttttattacaacactgctttgtcatttgttttatgagagagcgtggctatttgcaatttttatagggcatatagcgatgattctattattattgtttggaagattgatttttgaacttgattataagatatggcgcctcttccttgagatgattctgggaataggatgttgttatatttaccgatttttcagaggaatcggagacgtatcaagaattgaaaaggcatcttttgaagatgacgaatatttttattatgtaaaggcagttcctaagattaaagttacacaaaaggataggaatgtgacagatattaaatccggcgagaatgaggatgacatcttattcgatgatataacagaagaaaccgacctgtttgatgggaatagggaggaagcagagaaagagtgaaagggctggataacagattatgcagttaataagtataggacaatttcacaaagtaatagaaaagtatttatattggctgtctctgccatctattggatttactgatattttggagataatcattatcagtgtgattgtttatcagatgttgaagtgggtacagctgactcgggcatggacgttatttaaaggaattattatgctgctgttgtttgcattatttgcagcgatatttcagttaaatacgatatcatggctgctttcgaattctcttggtgtgggaattactgcagcaattatcatatttcagccagagctgcgtcgggctttagagcagttgggacgaaaaaagattttcagtaatcttttttcattttccacaggagagtatgatggaagacagtcagtcctgacagagaagacaattaatgagattgtgcgtgcttcctatgagatgggagcagtaaagacaggtgcactgatggtaattgaacaaaacgttgctcttggggaatacgtgcgaactggaatctccattgacggaatagttagcagccagcttcttatcaatatctttgagcataatacaccattgcatgatggagcagtcattataagaggcaatcgtatcgtgtcagcaacctgttatcttccgttgacagatagtatggatattggaaaggaattgggaacaagacatagggccgcagtgggaatcagcgaggtttcagacagtctgacaattattgtttctgaggagacaggtgctgtgtcacttgcgaaggatggaaatctgtataagcatttgaaaaaagaagagctgttagagaagctcaaacagttaaagattgacgaagaaaataatacagatgtatttaaaaaatggaaggacttgttgcgaaatgaaaagtcagaaaaataatatgtggatgaagatactttctgtcgttatagcagttttaatatggctttttgtagcaaatacaaatgatcctgtagttacgaagagattttacagtattcctgtaaaggtaatgaatgaggatgcacttacaaaacggggatacgcctatgagattcttgacggagaagaagtaaacattaccgtaaagggaaagagcagtattgtccgttccatgggaatttctgattttcaggcgattgcggacttttcaaaattgtcaaaagtagatgctgttccgattgatgtcacagctaagaaatattctgaccagcttgatattacacttggaacaaccaatactatgaagattaaaaaagatgaagtcgtgacgatcagtgttcctgttaatgttacagcgaagggtgatccagcggaaggttatgctgtaggaagagtgacaagtactcctaatcttataaaagtaagcggtccggagaatctgctctcctcagcgaaagagattcgtgcgacagtcagtgtggatggaatatctcatgatgttacagctacagataagccagtgctgtatgatgaagaagggaaaaagattataagtaatcagatagagtttgatacagcgtctataggaatttatatagagctttggaagacaaagactgtagatgtcaagttaagttataccggggagcctgcaaagaattatcatcttgtttcttttgattatgaaccaaaacagattacgattgcagcaccggatgatatgctggaaagtctggattccattacattagacagtgtatcaattgaggggcttacggaagattatgagaaggatattgatctgacccagacagtactccctgataatgtaattttggcgaatgatgataccagtgatgtaaaagtaaaggcaacgattgaaaagataacctcacataagctttcctttacgaaaagggatatcaatataacgaataataccaataattataaagtaagttttgataaggataatgactattctattcttgtggatggggcagcttctgctgtaaaaaaactggatattaaagattttgttccgtggattgacattaatggattagaacctggaactcatgaagtatcacttcatgtcaaagatgtggagggagttacagtaggagctacaacaaaacttaaaattactttaaaagaaaataattaatgattcagaatatatttgccatatggattttcaggaatctgtatggctctgaattattatgagaatcattataaatagcggatttaatgaattgaggaaatgattatatgagacaaaaaacagaaacaatgctttgtgttgccttcatggaactattaaaaaaatgccccttttcaaaaatcacgatacaaaagattgccggtcaatgtggagtaaaccggcaaactttttattatcattttgacaatatatatgatttgatgtcaaaggcatttgagtatgaattagtacatgaaagccgtatatatgaagaagtaacatgggagtatgcaataaacagctttttgcagtggatgaaagagaatcgggtaatcatcagaaatattcttgcgaatgcggaactgccgtatttaaagcgggctatgtatcctcttattgccaaaagtatatcttgcggatcttttatgcaggagagtatgcaacctgcaataaaacagcaggaagaattctgtatcaactttttgacaataggaattacccagtatgttcttgaatgggtggaaagcgatttcagggagtcgatagatgacattgttgatcatatgtcatggctattgcagaaggtatattcataaataaattttttatatagtggtgatatcgaatgagaaccgaattcgccgagactggggatggaaagtattggttgcaacaaaaatctgccggtataagaatgccggtgatataggaggattttaatagaaaatgatttccagtacatcaaatgcaaaagttaaaaatatcatgaatttaaaaaagagtgccaaagccagaaagaaagaaaaatgttttctggtagaaggcccgagaatgttttttgagattccaaaagacaggatagaagagtgttatcttacagaagaatttgaagataaatacgcagaagaactgaacggctggcattatgaactgatcagtgaaaatgtatgcaaacatctttcggatacgaagacccccagggcgttattgcggtagtaagaagaacggagccaagtattgaggaacttcttcataaagaaaagaacccttgctttttcctgttagagaatctacaggatccaggtaatcttggaacaattgtgaggactgcagaaggagctggagtgacaggaattatcatgaatcgggagactgtggatatttataatccgaaggtaatccgttccacgatgggagcgattttccgtgtcccatttgttatcgcagacagtctgccagaagttattttccagttaaaacagaatggggtttctgtgtatgcaggacatttaaagggagatgtattttataagcaggattaccgagatggcagtgcatttcttattggaaatgaaggaaatggtcttacagatgagattactgcactggcagactataagataaagattccgatgaaagggaaagtagaatccctgaatgcggcagtttcggcaacaattctaatgtatgagacgatgcgccagagagagtttatgtagtttaattcattaagtaaacaacagacgaagccagtgaacttcataagccatatttgtgcttttagtcgcggcgtgttgaatgttcgctccacacgctcgcatccaacacttgctccgagaccacaaatatggcttatgaagttcactggcttctgtactgtagctggagaaggtgaattaaacaggataaggggatttgggaagagaagctgatgtcttctgcttactcgagaatgactgggaatagagggtatgatttgacctgcctatatgtaatagtaagataaaaaaatatctatttacaatattctgagagcaagcagaaaacttctgtcctctcccccaaatccccacaaccactatcttaattcaatcaaaatccagccaaagacagcccgagaagagatacgatatcctatatttgtggcctcggagcaaggtttagatgcgagcgctttaagcgagcatttaaaccgccgtgactaaagtcacaaatataggatatcgtatctcttctcgggcgtctatctcttaatgaattaaatagtaaaattatagttgcatacaaaatgtagtataaataaataaaaataattcaataaaatggacaaaacaactaccagaaataatttgttaaaaaaataattatctaatatgcttcaaaaaccacaaattttaacgtgatttatcatgcaaaaagacgatagaaacatacaaaaaaagcgaattgtctaaatacaccgcacagaaattatgttaatataaaagcagaggtcaggaaggtattgggcttgaccagaacgtaatgaattattttaaggagggtttacttatggctaagtacatgatggcgttagacgcaggaacaactagtaaccgttgtatcttatttaatgaaaaaggtgagatctgtagtgtagcgcaggaagaatttacacagtattatccacagccaggctgggtagagcatgatgcaaaagaaatctggcatactcagttatccgttgcacgtcaggctatggagaagcttggtgttacagcagcagacattgctggtatcggtattactaaccagcgtgagacaactatcgtttgggatagagaaacaggaatgccaatctatcatgcaatcgtttggcagtgccgtcgtacatctgaatactgcgattccttaaaggaaagaggattagtagataaaatcagagaaaaaacaggtcttgttattgatgcttacttctcaggaacaaagattcactggattcttgagaacgtacctggagcaagagaaagagctgaaaaaggcgagttaatgttcggtacagttgatacatggttaatctacaacttatcaggaagaaagattcatgtaacagactactctaacgcagcaagaacaatgttattcaacatcaatactcttcagtgggatgatgagattttagcagaattagatattcctaaatcaatgcttcctacacctaagccatcaagtgaaatttatggtatgacagatgagagcctcttccagggaagaattcctatcgctggagcagcaggtgatcagcaggcagctttatttggacagacatgtttcaatcctggtgaagctaagaatacatacggaactggtacattcatgttaatgaatatcggtaaagaagttaaattatctgagaatggtcttgtaactactatcgcatggggacttgacggcgaagttaactacgcattagaaggttctgtattcgtagcaggtgcagctattcagtggttacgtgacgaagttaagattgtagacgcagctccagattccgaattcttctgtaacaaagttccagatactaacggatgttatgtagttcctgcatttacaggactcggagctcctcattgggatcagtatgctcgtggatgtatcgtaggtcttacacgtggatgtaacaaagctcacatcattcgtgctacagtagaatctcttgcatatcagacatatgatatccttgaagctatgcaggctgatgcaggtgttaagttagcagcccttaaggttgatggtggagcttgtaagaatgacttcttaatgcagttccaggcagatatcattgacgctcctgtacatcgtccacagtgtgttgagacaacagctatgggtgctgcataccttgcaggtcttgcagttggatattggaacagtaaagaagacgttatcgctaactgggctatcgacagagtattcgacccacagatggatgatgacaaccgccagaaattacttaaaggctggaagaaagctgttaagtgttcttacggatgggcaaaagaagattagttagaatttgattaataagaattagccatttagttacataataaaggaagctcccccaccgagaggtgggggagcttctggtttgccgaatggcaaagttgacgccaccaaaaagagaaagaacctatatttgtggcctgggagctgcgagagtgtaatatgatagaaaagcccgacattaaaaaatattgattttgacgactttgtgttttgtacaactgagtcaaaatcaatattttttaatgtcaggcttttcatagaagactatttcttgcagcgatgaaagtcacaaatatagcgtatggtattccctgggagcgtctgcttagccaatgaattaaaagccaaaatcctcataatcttctggtaagaatctatggtatacgatttgaagttcttcatccttaaagcaataataatatgggtcatctctgtcagtgaatgtgatcagaatatcaaattcatcgttattgacttcttttataacacaattcttatcccattctttaaagaaagaagtgactgtctcaagagaagtatctggttttaataataactgaatcagttcgaaaataaactcatttttctctttatgttcatggacataagtaggggcagcttcgcttaaataaaagcagaaacgatgttctttatactcaattctagtttctccaaatctaggggcaacaaaatcaataaattcctgtaatgccttattcatctcgtcagcttcccactcactgttgaagaaatgatttaaagtacggagtggatagcagaactgcatcgtatttttgctataacctagttttgcctgtgcttcagtgatattatctgttaaactgcgttctaattttttatatgcttctgtgtacataaaaacctcccggtagtaaataaatatatgttgaaatataaattaaaacccttttaactgcttcaatttggattccatcccagttaataaatattgaatttaaatccttaaaaacagctgttgttatcatagcatattttcaaaaaactctaaagaatatctttcactaatttgcaatagccaaagatagcccccgaggtcacaaatatagaatatcttctctcttcgggagcgtctgtctgtcactacaaaccaacttttctgtgtttatccagcaacattaacttttcccattcctccacatcgttatcccactgtttataattcgcagttcccctgcggtcaggaagaccatactcttttttcagatattctccaagataggcagaggtctttttagcacccttgatattaagatggtcgccgccatctacactatcttttttccaattaatctgttcctttaattccagattcagatcgacaaagttgattccgtttttatcggcaatttcctgtaaggcattatgcttttgataattccatccgttatagtttggaacggaaatcagaacagggatggaaccctggcttttgcagtaatgaatacacttggaaaaagtagaagtactgagtttgttaatctgccagcattttctggtgaatttcatgcggtgctttttcttatgtactttatgagaggcctttcgataataatatcctttcataacggagtgttgattcccaaaaatatttttcaatctgcgaggattcagatttttgtggaaactgataacagggaaaatagttgcaagtttggcctttgtgatagagtcgagattatcaatatcggttttatcacggaaaaggttattgccatcaattaggacgatagatggtttctggtgtttataaattttctttaaatattcataagtttccgggatacgctggcttggctgtccccaggtatatccggtaaatccctgttgttcccaccatacgagagggaaaatgctgctgtatacattgctgtctccgatggagagtacatcaatactattatctggctcctgaaaaatgctatagctggaatagttatacagcggattagcgttatatcccatagcgatagaaagggaggaaaagattttcagtataaacgctaaaatcagcaggaaaattacgcttttcgttatcattcgttttttagacattttaaatcctcctgtaagttaaaatttagcgtaaataaaatctgcaacgccccatcctggtccgtaggctccagcaatgataatcaatacaatcggaattatatagatggcccagcgaatcggtaatggctgtgcaagaatcagttcacggatagaatgaccattttcctgtttctttccgataaaataaaggagaatgacactgaaggcaataagcagaaagtctaatttaaatagaccgcctcggttaaatgccagttgccagaaattagattttccatgccacggttgaaatacggaaccaagcatagtgattgctgttttaatatcctttgaccggaatataagcattccaatatttacaaggataaaagtacgcactacctgcattgtatgataccaggaagcatttctgtcgatattaagtttgctgcaaaaacttacgaaagccggttcaagcaacattccaagaaccatgataacgtagtaataaagtccataaataatgtatttccattcggctccatgccagattccatttccaaaccaaacagcaaacaatgcaaaaatgccaggaatagttgcggcatagtaacggttcatatgttttctacagttctgactgaatttctgaaaatgcgttccgagggagattggataaaaaatgtaatctttaaaccaggctccgagagtgatatgccatctgcgccagaactcattaacggaagtggcgaagaaaggccgtttaaagttctcttctaatgtaattccaaaaagctgcgcgcttccccgtgcaatgttgatacagccggcaaaatccatgtagagttggaatgtatacaaaagaattgccataataaccggaaacccggaatatttctcatgatttgcaaaaatagcgcggacatacatatttacacggtcagaaagaagaactttctgaaaaagcccccacacgataagctgagcgccaaaacaaaattgcttataatcaaaatgatgttctgcttttaactcttctccaagctgtccataacgagaaattggtccctctgtaataatcgggaaaaaaatcaaaaacaggagaaggcgaaaataattcttttctgctttgcatactccccgggcaacatctgttacataactgatggcagataaggtatagaaggagattccaagtgggagaaaaatatctaagaatggaatctgtgcggaaatatgcagtgcatgaaagagagcgttgatattttcaccaaaaaagttaaagtactttgtgacaaatagaataccgaaattaatgacacataacagtgcaataatataacgattcttttttgttattttactctttagttcttttcgggcggcacggtctaactcttttttctttaacttgaactgttcattgaattcttcaattgttcttgcaccaagataaatggttgccgtcgtaaataaaacaacggcaaccagattcttcattgcaagaatatagaacagcaggctcgaaaaaagaagaccaatccagcggcgttttacaggaattaaataatatagaattatgctgccgccaagaaaaggaaagagatagagccatgaattatactgcatattctcacctactcatcttctaaaatttcctgaaccatgttgtaaatgctttccacagacttaaagttctctggtttaatataaggaagcgtgatattaatatcaaattcgtcattaagttcagatacaagctgaagaatctccatggattctaaaagatgttcttcgataaaatctgtggatgaagcaaaatcagctcccggtttaatcgtttctaaaatttcaagaatagtgtccataattaattttcctccgtatagtgtttataaatattgttatagtcattgtaatagttactttttatatagttttttctgctatagtgttatagctgattttcttccagatagttcgttttcaataactttctattaaccttaccatttgaattgtaaggcatctgacgaattcgaatgaatttatttgggcgcatataagcaggaagtttgcctgaaactgccgccgagagagattcctgtttaatctttccctgataaaataaaagaatttcgtccgtagtttcaagataaatgcatacacatgcatgaatttccggaagtgcgccgatggcagcttcaatttcaccaggttcaatacggtatcccatatgtttgatctggaaatcttttcttccctgatatcttaaaagaccgtcctcgcctctgtatacaaggtcacctgtacggtatacgatttcgggataagcatcattcagtggattctgaacgaaaacttcagcggtcttttccggattatgataataaccatctgcaagaaatgggcctctgacaagaagttcaccacttgtggcttcctttccgttctcatctgcaataatcaaatcacagttgctgcaagcaacaccaatcggaagtgtctcatcatcagaaaatgtacgatttacgacataataactgcatatatcggttgtttctgtcggaccaaacaaattggcatagaaaacatcagggagcgccttccgccagtaatttaattgttttactggcatcacctcgccagcaaacagcacttttttaagatatttcggtttaatataagcaaatgtatcccaatttgccacaatattaagcgcagaaggaacccagtaaatcgtatttatcttataagtgttcagatattcaataagctgcatcggaaatgaaaaatactttttcggaataatctgatacgttgctccagtacgaagtgaggcatacagatcagaaacagacatactaaaatacaacggtgtctggcttccaaaaacagttctttcattaatgtcaaatgcgtgaatgaaccagtcgctatatgcaattaacgcacgatgactgatcactgtaccctttggctgtccagtagagccggaagtataaagaatataagcaggatcacgttccgtcatctgacttctcaatcttccaagaagttttgtatctatttctgttgaaatactgtcttctatataaaatgttttataaaacgttttcagtttatcctctttaatctggctattttcgcagctttgttctgtaatagatgtactatttatcgcattatcatttttaaaactattaatagattcaactttatcaatataagatttatctgtgagaatcgctgccggctgcaatgtttcaaaaatacggcgaaccctttctacaggcatctgcgtatcaagaacaacataaaaattgccgctgtaaagaacacttaacattgcctccactaaagccggactcttatcaatataaatagccacaggaagggaatcttgttttagttcagaagcaatcatagtaccggtctgctgacttcttgtttttaaatcattaaaagtaaccgaagaagattcatttgctaccgctatatgattgggaaactgctcacaggttttctcaaaatactgcaatatatttttcattggtaactccttaatatcattgcaaatattccaattgtcaaaaatggaatattcacagctatagatgttgtttataactatagaataacagaaaaatcttaagcataagataaagcaaatctaaaatattcttaagaaaggggattactatttaattcattagatacactacagacgaagccattgcccccaataaggcatatttgtgattttagtcgcggcgtgttgaatgttcgctttatgcgctcacatccaacacttgctccgagaccacaaatatgccttattggggacaatggcttctgtgctgtggctggagaagatgaattaaacagggggaggggatttggggacagaagctgatgtattctgcttactcgacaatgactggtagcagagggtatgatttgacctgcctatatgtaatagtaaaatgaagaaatggcattttaaatttgattttataaatattgctgatgataacataataattatatcaatttgcttaaaatctagtatagtatccaatcagtaataatagtttacgaataatcttttagcagcttacaataaaagatacacgaatcaaagtgggataaaaaatatctatctacaatattctgaaaacaagcagaaaacttctaccctttccctcaaatccccacaaccactatttaattcaaacaaaatccagccaaagacagcccgggaagagaaccgataccctatatttgtggcctcggagcaaggtttagatgcgagcgcataaagcgagcatttaaaccgccgcgactaaagtcacaaatatagggtatcgtggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaggcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccaaataccctctatttgtgactttagtcgcggcggtttggatgttcgcttatgtgctcacatccaaaccttgctccgaggccgcaaatagagggtattgttttccttctcgggctgtcttttgtttgaattaaatagggtattgtctctctttgggggcgtctccttgcctgcggcaggccagaatttgccatagtgtatatagaaatttcgggttacaagcaaatatatttacaaaagtaaaaataaagtcaaaattatgcctaaaaattcaccaaaatatttggataaattgaaagaatgtaaaaatataagccatatttttattgacaatctaaaagggagaatttataatagaaaatagttacgggagggataaattatgagaaaggtaattgatgacccacgccttatggttcgggtatgcgatttatattataatcagggtatcagccagcagcagattgccaaagacttgaatttgtccagacctacggtgtcgagggtactggcacttgccagagaacaaggcattgtaaagattagcatttcgaatgtagatgcagtggaacattgggaacttgagcgtaagcttgagaaagagtatggacttcaggaagtgattatcgttggggagaattcttccgaggataagatgaaggaagcattgggagaggcagcagccagatatctggagtatacaattaaggacgggaataccgtgggagtttctatgggttctaccttatatgaagttatttcccatgtgatgcatccggaagcgaagagagttacttttgttcctatagttggtggtgtcggaagagttcgtatggaacttcatgcgaatagcctggcagaatcattgtcccgtatatatgatggaaagtttgtaccactacatgcacccgcgcgtgtttcaagcaggaatattcgagaggagcttttgaaagaagagactttattaccggcgatacgtttgacacagaaacttgatattgctgtagttggtatcggttatccgaatgagaagtcagcaatcatggcaacgggatatttcaaggagaatgagattgattctctgattaaccgtaaggttgcaggagaactgtgtatgcagttttatgatattaagggagatacttctccatatgaagatgataataatgtaattggaatggatataagtaagcttcgtaccgttccacgctccattggtattgccggaggtattgagaagctccgagctatcagaggagcgattaatggtcattatattaacacgttaattacagatatccaatgtgcggaggcactgatatctgaataagatatgaggatgagacggatttgtttcagaactcatatgaatatattttagttatatttaattcatgtttttaatcaagggggtaaatgtcatggatgaaattcttaacctgtcaattaacgagatgccacaaactgagtttgattgttcttgtggaaagcaccacaactttagtgtacatgatatgtcaatccgtaaaggagcgattgaagatttacctaagatggcagagccatttaaagatggtaagattcttgtagtatttgataaccatacttataaagtagcaggtaagagagcggtagaactgttaaaagagaatggctttaatgttaaggaactgttatttgacacaggagatgacattttaattccagacgagaagactcttggaagaatagtacaggagcaggatttagatacaagccttatggtagcagttggttctggtgttatcaatgactccgttaagttcgtaacttcccgttccggacttccttatatcattgttgcaacagctccatctatggatggatatgttgcagatggcgcaccaatcttttcacagggatataagtattctccagtagcacatcttacatacggacttgttggagatacagatattttaaagactgcaccacaggatttaattcaggcaggttacggtgatgttgttggtaagattactgcaatcgctgactgggatttagcagttaaggcaaataacgattatcgctgtgatacctgtgttacattagttaacagagcattggacaaatgttttgcaaaagcagaaggattaaaggacagagatccagaatcacttggagctttattagaggcattaacattaacaggtgttgctatggcattagttaatatttcccgtccagcatcaggagcagagcatatgttgtctcatttctgggagatggactacattgcacgcggcttaaatccaaatcaccatggtattcaggttggtgttgcaactccaattattgcacgtttctttgaagaattagcagatatccttccagaaggaactggagcactttgccctcctcacgaagagattgaggcacttttagcaaaaggcggtgcaccaacaagtccaaaggatatcggtatcagcaaagaactgttccacgacagcttactgaagggatacacagtacgtcctcgttactccatcatgcagttcgcaaaggataacggccgtctggaagaaatcgcagataagattacagaagagatttacggataaaaaataataaatgcactctcggagtcttaaggtatttctagctataactggatttggaatcataattttagatatataaaatcaagtatgagtattcagtattttagatataaaaattataaaagcaggtataaatatttatctcagtcgagaagactcccacctcttcagggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaatcctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcccgttatcataaaactactcagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacactattttagcaatattttattatcaaggaacattttggcatatatttgacgccctgtgatactaaacttaccactttttcagtggcgtccttcaggtggtgagtaatagcaaatttgtctcagtgggagtccaattcccgactgagataaacgctccgcgaggatgcgcagtgattctgataggaacatgtcagcttcgctgaccagaatcacgcgccaagtctcacggacgttcgacttgaaaaagttagatataaagattcagggagtgtatataacaggtaagaggtagattttatgcagaaaaaggaagacgcattaaaaggcgttaaactatttgtccttgatatggacggaacagtatatttaggaaatcacatgattgatggagcgctggacttcatacacgaggtagatgcttctgaagacagagattatattttctttacaaataatgcttcccgtgttccatctgtttatgtggagaagcttcataaactgggcttggatgtagatgagagcaaggtagtaacagccggagatgtatgtgcagagtttttgaaagtgaattatccgggagcaaaggtttatttaaatggtacccctgttcttgaagaaaactggaaagaaaaaggaattcatcttgtggaagaagatcctgatgtagcggtacagagctttgatacgacattaacttatcataagttagacagaatctgtcattatgtaaggaatggtgttccttttatcgcaacgcatatggataccaactgcccaacggaatacggatttatgccagactgtggagcaatgtgcagcctgatcacagattcaacaggagtgaagcctcgtttccttggaaagccatggaaagagactgtggatatggttgcagaaatcactggatataaagcagaagagatggcatttgtgggtgaccgtttatacacagatgtggcaacaggtgttaacaatggagcaaaaggattcctcgttttaactggtgaggcggatatgcagactgtagcagaatctgatgtagaaccgacttgtatttatgattctttaggtgaaatgagaagatatttataagataatcttttgctaattgattccagagaatttatagtataaaatattaaataaaaaagcagattttctgcggaaaaaggagaattaaaaatgaaaatagtatttggatgtgaccctaacgcaacagaatttaaattacagttaatggagtatgtaaaaggtcttggacatgaagtagcagatttaggaagcgatgatcctatctatgctaatacagcaatcgaagtagcaaaagctgtagcagcaaaagaatacgatagaggaattattgtttgtggaacaggtattggtgtttctattgcagcaaacaaagtaaaaggagcttatgctgcatgtattcatgatgtataccaggctcagagagcacagctttctaatcatgcaaacattattactatgggttcacaggttatcggaatcgaacttgcaaaacagcttgttaaagaatatctttctgtagaatgggatcctaactgcagatctgttgcaaaagtacagagaatcattgactttgaaaatgaagaataatctatcagatcttacatgcgcttgagttgaaaaataagagtgggtattgggtaaaacaatatagcatagaaagtatgctttaatgatgaaaggagttacaaaatggcagaatatttaatgggtattgatgcaggaaccggtagtgtacgagtagcgttattcgatttcagaggacagaatcgtgcgtatgctgttgcagagtatggaactacttatcctaaaaatggatgggcagagcagagcgattacgaatggtttgaggcattaaagaaagcaattcctgagtgtatcaagaaggctggtattgcagcagataatatcgcagcgattacctgtgatgctacaacaaacacattagtgtacttagatgagaatgatacttctgtacgtccgccgattctctggatggatgttcgtgcgacagaagaagcatccttcatcgatactattcgcgaagaatatgatgcaacgaagttctataaaccaggatttagagcagacactatggttccaaagtgtatgtgggttaagaagaacgagcctgaaaactgggcaaaaactaagacaatcatggaatttgaagactggctgaactggaagcttacaggaagaaaaacagtaagtatgtccgttgcagcattccgttggaattatgatgataaaaatggcggatatccagtagacttctataatgcagtaggacttgatgatgttgttgataagttcccagaaccagtattaaaagtaggagaagttgttggtaatatcagtgcagaagctgcagaaatctttggtcttagcaaaaagacagttgtagtagaaggtacagcagactgtaatgcatgtatgtttggcgttggtggtgtaagaccaaacggtatgacattaattggtggaacatctacctgtctgttaggtctttccgaagaagaattccatgtagacggtgtaaacggaacatatccgaactgtatgtatgatggaaccagtcttttagagggtggacagacagcagcagggtctatcctgacatggtttaagaataacttacttccagcagcatggatgcaggaagcagtaaaccgtaacatgaatatttatgatctcatcacagaaaaagcatctgaagtacctatcggatgtgatggtcttgttatgatggattatttccagggtaacagagctccttatgcagattccaaggcaagaggaatgttctggggcttatccattggtacaacacctgctcacctggcaagagccgtatatgaaggtgttgcttacggtgcaaatcactgtatcgtcagcatgaagaaagctggatatgatgtaaaagaaatctacgcttgtggtggtttagcacagtctgatttctggatgcagatgcatgctgacatcatcggtgttccaatgtacacaacagtagagagccagagtgcaggatgtcttggtgactgtatcatcgcagcagttggtgttggtatttaccctaacttctgggaagcagcagacagcatgatccgtgtagataaagagtatatccctaacatggaagcacacaaagagtatcagttctatatggatagatacatggaaacatggccacagatgagagaaattgtacataaaacagtagaccataacaacaaaaaatagtattatattaatattgtaaataactaataagcccgcggaggatacgttacctgtatgcttcgcgggtatattagattttaacttggaggattaactatgtcagaagtaaaagtaattggtatcggtaatgatcacgcagcagtagacctgaaaaatgaaatcaaagcatatcttgaagaaaaaggctacaaagtagtgaactacggaacagattcttccgaaagctgcgattacccagtctacggggcaaaagtaggtaatgctgttgcaagcggtgaagtagatgcaggtgttttaatctgtggaacaggaatcggtatctccatcgcagccaacaaagtaaatggagttcgtgcagcagttgtaagtgagccggtatctgcaagactcacaaaagaacacaacaatgcaaacatcattgcattcggtgcaagaatcgttggaagcgaaatggcaaaagcaatcgtagatgcatggcttgatgcagaatatatcggaagcggccgtcatgagagacgagtgaatatgattgaggaagaagcagcaaagtataataaatagaaaaatatcttaattctattttagagcgtgtttgaagaagtagttttcgaacacgctttaacactattttaagatttttatttatagagattttcaggtacttctactctgagtacttttataaaaaagaaagaatttatggctacatagccacggaggaagattatgagtcgttttatgacaatcaaagcagaagaaatagcagaagcatttgaaaccgagagaagacagtactttgtcggaaacttaaagagaccacagcatatcccttttgtaaagtcagagactacagagatgggtctgaccgtctatgataaattcactggcgagccagcacacagacactccgtagcaaaagagtatgcctatgttatctccggcagaactcagtatatggacttagatacgagagaaatttatgaatatcacgcaggagacttcttcgttacatttccgggaacaacttatgttcagaaggcagaagccggaacgaaaatgatctttgtaaaagaaccatcgattaatgacaaagaactcgtcccgatggatgaagaagcccaaaagtggatggaaacagaattctgatttgtgaagctgcggagcagacgaactcctgaagctaaataaagcatatttgtgactttagtcgctgcggtttgaatgttcgcttaaagcgctcacatccaaaccttgctccgaggccacaaatatgctttatttagcttcaggagttctgtgcattgacagctcagaaaatcagtcggagagatttggggaagaggacagaatatgtagaagttccgggaaatgaaattctataggattgacacttgaaccagtgccataatcgtatagttatttatggtcactactttctagagtgtgtttataaatttattttttgaaaaaacaaagtaatttgtggtaagcacgctctaaagaaagcaaaaaagttataaggcgaatggctaaatcccagaaattttccaaagatagttataatatcaaatgatttaaaatgataagataagtgtcagtcctccagtatttcaatccctcaaaaaatcacaacccgttgaagtctccctcaaatctttctcaaaataaattctgagtttgaataggcagccaaagacagctctcagtaaataaaataacctatatttgtggcctcggagcaaggtttggatacgagcgtgtgtaagcgagttattcaacctgcagcgactaaagtcacaaatatgctttattttggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgccttctctaattcttccctgctctcaaatttcttcccataatacatttcccgtttcaagatcccccaaaagccttccattactccgttatctgtacagtgtgctactctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctgggatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttcttcctttagtcatgattgctctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgtaacagaactgatagattctttcttctgaagaatttttttcatccattgtattttttcttctggagaaatcttatccataaaaaatgccccctttcagataaacagttttatttttttcaactgtctacctaaaagggagcatatcatttagcttcgggagttcgtctgcttcgcagcctcacaaatcagaaatcttcttgcttatattctggtgttttgctatcatttaaggtgcaaatacaagaaagatatggagaacattatgataaaattaggatgccacgttggcatgagcggtaaagaaatgtttctgggttctgttaaagaagcaatttcctataacgcgaatacatttatgatctatactggtgcgccacagaatacacgcaggaagcctgtggaggaacttcggattgaagaaggatgggctttgatgagagagaatggtattgatgagtttgtagttcatgcgccatatatcattaaccttggtaatacggtaaagtcagagacttttgagctggcggtggaatttctgcaattagagttggagaggacacaggctcttaagtgtaaaacacttgtacttcatccgggagcgcatgttggtgcaggggctgatgtgggaatcaggcagattatcaaaggcttaaatgaagtattttcgcaagataaagatgggaaagtgaacattgcactggagacaatggctggtaaaggaacagagattggaagaagctttgaggagattgcggctatttatgatggagtgacacataatgaacgtttaagagtctgctttgatacctgccatacgagtgatgcaggatatgatgtgcgagaagattttgcaagtgttatagagcagtttgatcggattataggtaaggatcagatcgcagtttttcatattaatgacagcaagaatccacagggagcacataaagaccgtcatgaaaatattggatttggagagattggatatgattgccttcggaatattgtatacaataaagactttgaagccattcctaaaatattagagacaccatatataccaaatccagaaacaaaaaagagggcatttgctccgtataaatatgaaattgcgatgttgagagaaggtgcatttcatgaagatttaaaagaaaaaattttggagggaaataaatgagtaaactgactgtaacatatattaaacatagcggatttcttgtagagacggcaaatagttatttattgtttgattattggcagggaaaacttccagaattacagtatgataaagaactttatgttttttcaagtcatgcacatcatgaccattatacaaaagatatttttaaattagaaaataaatgccagacagtcgtatatgttttatcttctgatattaaaagagcgagcagtttctggaaaaaggcagagaatgttatttttatgaaaccgcatgaagagaaagagattgatgactgcgtaatatctacattaaaatcaacggatgagggagttgcctttcttgtaaaaacggaaggcaagaccatttaccatgcaggagatcttcactggtgggattggccaggtgagccggaagaggataataagatgatggaacagctttataaagccgagatggaatatttgaaagcagaaaaaatagattgtgcctttgttgttcttgaccccagacaggaagaatcgggaagccttggcatggaatattttataaaaaatgtgggagcacatttcattttcccgatgcattgttgggaacaatatgatattattgaaaagtacaaaaaagatgtagacagaaagttcctcacagggcagattatgaatattactgcgccgggacagcagtttgttctggattaagtatttatcataatacaaaccgtgggatacacggggttaacccgcttatgcttagcacagaggtgctattgaacgagaaccaaactcgccggggttgggaagcctcatctgtaggtgggggagaatgtcacgataagatagtataaaacagaaaggaagaacatcatggaaaagaaagttatcgtatcagaaaaatcaccagcagcaatcggaccttattcacaggcaattgaatataatggcattgtatacacatctggagttatcggtgtgaatccggcaacaggtgaagttggagaaacaatcgaagaacagacaacacaggtatttgagaacttaaagggacttcttgcagacgcaggcagcagcttagaccaggcaatcaagacaactgtatttattaaaaatatggacgattttgcaaaagtaaatgaaatctatgctacttattttacaggtgcatttccagcacgttcctgcgtggaagtagcaagacttccaaaagacctcttgatcgaagtagaagtaactgcgatcaaaggctgataaactctatgttacagtcaggaatcattgagcttgatgtccatagtatgaacagggcacaggcaaaaacatatattgacagtcagcttaaaagagcaaaaaaagatatctaccagataaaagtaattcatgggtatagaggtggtactgcaatccgggatatggtccgcaaaacttataggaaccatccgaaggttgtgcgcgtggaactgccattgaatccgggagaaacgaatctgatattgaaggagtacttctgatttaggaaacagacagaagacagtccacaaagaaagaatacagacctgtattctttctttgcgggtgtctctatcattatcatgaattgaatctttcccacaaatgtggtaagataagactaattaaaactgcttttttcttaattgagaaggggaaaaaagtgaaatatatgtataagtatagaggaggattaaaacatatggtacaagcggagctgactattacaaatgagcagggaatccatttgggaccagcgaataaaattgctaatttggcagaccgttatgattgtcagattcattttaagacggattacatggatgtgaatgcaaagagcattatcaatctgattagtggaacgttcagacatggagatgttgtacagtgtgtttgtaatggaccagatgaagaagaagcactagcagcaatgaagaggatactctcggaaaatttagaagaataaataggaatttgccgcaggcaaaagagacgccctctgtaagataaataaagcatatttgtgactttagtcgctgcaggttgaatgctcgcgtaaaagcgctcgcatccaacctttgctccgaggccacaaatatgctttatttatcttacagagggctgtgttttggctggggatgaaattcctatttattgctgaagtgatttgtgggagaaatcaggagagatagaagtaattcggaaagttaaatctttcaggattgacacaagattaataagaaaaaatattatacatgcatctgttttaatatgttttcagcatactacaacaataattcaagtatcagtccttcaaaaaacaactccacagaaagccacatccttctggagcctattcaaatccctccagtaataaatagcaattttctccccagccaaagcacagcccccgaagagagtctagtccctatatttgtggcctcggagcaaggtttggatgcgagcattcaaatcgtcgcgactaaagtcacaaatatagggactagactctcttcgggggcgtctctttgcctgcggcaaatgcctatttagaggccaaataggcatcaagtccctttttgcgcagcttacatgatgggcagtgtccacatccgtccccaatgattccgttatagcaggtcaatgtttcatttctgataatatcgaatgcgccaagttcatctgctaaagcccatgtttcttttttgtcgagccacatcagaggtgtgataatatcaaactgatagtccatagcgaggcagagggttgtatttaaagacttaatgaacatatcacggcagtctgggtagccggagaagtcgctctgggatacgccggtaataatgtctgtgatgcctctctgttttgcaaatactgcagcgtaggaaagaaagagaagatttcttccgtcaacgaagctgtttggtgttccctcttctggtgcgctttcgtctactttgatatctactcgtgtgagggagttaggagcgagctggtttaagaggctcatgtccatgatgtggtgttctacttcatgatcacggcagattttctttgcacactctaattcttttacatgtttctgatgatagtcgaatgataaagcgattacttttttgtagcgttttaatgcccagaaaaggcaagtagtactatcttgtccgccgctgaaaacaacaacagcagcatctttatttttaagttcctgcatgaatgattccttctttcgtgtgtgatggtaaatctctatttattatatagataattttgaatatgagtttttatgtccttattttacgcatgcagcatcatcgcaagctggctctgaatggtagcatctgtctcaaagcgtccgcggaaagtagttgtaacagtagatgcggcttcttttttgattcctcgtgcgctcatacagctatgtgttccgtggatgattacagcaacatcgtctgtctcagcggcttcgcacatgatttctgcgatgtcggagcctattcgttcctgaagctgaaggcgtttagaagccatgtcacagattcttgcgattttgcttaatccgagaaccttttcttttggaatgtatgctacggaaacagacatatcgtacatgagggcgatgtggtgttcgcaatagctgaaaatcgggatatcccgaactaagacgatatcttttttatcggagccgacacataaatcgtctttaaatgatttattaaacatcatggcgatttcatgattggtgtagttcattccctcaaaaacttcctcgtacatacgggctacacggtcgggtgtttctttcaatccttcacgatcagggtcatcaccgagggcggcgagaatgcctctgacgtgttcacgaatggcatctttatctatagccatgttttctttcctccttttatactccgcgctgttccggcggccagataaacttgtgcatctggagctggagacgggcttcattccaatggtgttctatcatatattcaacaatttcttttggttcaattcttccaaataccggacttaaaaaaatagggcaatgctcggcaactttatattgtatacagatttcccttgccttgtctaaatcggaaatgctgctgacaacaaactttacggtgtctttaggaataagcagggaaaaattgtctgtgttcattgcattttccatgccgctgtccgggcatttataatccatagtaaaagccgggcggtgagcgagtgtatcgaaagtgttaagagaaacacttccattggtttcaatctctacggaaaaaccggcagtaccaagagcttcaatcaggggagcaatttcttctgtcagtaaaggttctcccccggtcaaagtaacattttctatggaatgttctttgagccaggtgattagttcttcggcagataaaaattcacaagggcagtcttttgtattggcccaggaagtatcacagtaattgcaggcaagattgcagcctctcattcggataaatgctgcgattttcccggctttttgtccctcgccgttgatacttacaaacttttcaactacgggataggttatcataaagaagcctcccggtaagtggaacagtttgtcggtgtttcgtatacggaaatgtcatatacagggaagttcagtcccttaagctgttcataaaaatagcgggaaaactgttctgcagtcggacggaaaggaacttcatgaagtaaaaatccttcgtctttcaatgcggcaactgttctctcttttaaagaacctgtttcaaaaatgaaagaatgatctaaagcatcagtaagctttttaagagcgttcttgaaatccccgaaatcaatgaccatatctctggtctggccttctttatttaattcgtccatagcaattcgagccacaactctccatcggtgtccgtggaggttactgcatttgccttcgtagccacttaaaaaatgggcggaatcgaaggactgctctgtttctaaaatatacattaaaaatcctcctaataaaaaagatgctgcaaacacacagcatctctaaatcatatattctcgtcaaatctttccggttaaaataaaatgctgtcctggttttgtttatcgacaggatggtacaaatgaactgtcgtatctaaccgagtttagcatgaaataagtactttgtaaaggagaatatcgaggaataaccgcatgaaaatcgtaattcgtaaatgaaataatcactttatgaaagaagaatatcaaaaaataatcgcagaaaaagcacattttatcctcttccagcaagaagactcccgtatctaaggtactttttcagtggtgtcctataggtgagggaggatgtcacaaataaaatggtcatcttataaagtaagaatcaagaaaacattatgaaaaacaaaaagggtctggttgcgaagttttttgggaaatgctattatggaaaaagaaaataaaaagaaaggacaggtaatgaatataattaataaattgtccgttgttatttctgtatataatgaagaagcagttttggacaagatgtatcaggctgttgtgccagtagtagaaagtctgccgtgtgaatatgaacttctttttgtcaatgatggaagcaaagatgcttctccggctatattagaccgtctggcaatggagtcagaaaaggtaaaagtcattcatttttcccgaaattatggacatgaagcggcgatgatagcaggtattgattacagcacaggtgacggagtcatttgtatggatgcagatttacagcatccggtagaatgtatcccacagattttagatgcatttcatcagggatatgaggtagtcagcatggtgcggatgtccaataaaagcgcaggactttttaagaatattacatcaaaattattttataaaatattaaatggaatttcacaaacacattttgaggagaatgcttctgatttttttgcagttacaaaaagaccggcggaagtgctaagaaagcattttagagaaagttcccgtttcctccgggcctatgtgcagagtatcggttttagaaaaacgacaatagagtatacagcaggagagcgggcaggtggcaggagtaaatacagtcttcgtaatctgttcaggttttccgttaaagcaatgatcagttattctgatttaccattaaaaatagcatctctttgtggaacatctgccggaattgcaagtgtgcttctgattatttattctatttatatgaaaatacacgttggtgcaccgggaggatatacaacaattatcgttgtaatttgttttatgtttaccgtactgtttttccttttgggaattatcggagaatacttgtcggttattttaggagagattaggagaagaccgatatatctggtgcgggatacagtaaatttagaaaaagagcaggaaaaaagcaaggaataatatgcttaaaagtttgacagaattactgtaagattgtaaaataagactatttatttctcgagcgtgtctgggaaattattcctgtaatttgtacgccgggaatgtagttagatgaaatgagctaaaaagtaaaaataaggtataggagaaaaaggtaaaaatttatgaaaaagtcttttaaagaattattaaaaggatgtttgaaaccagcaacttctaagaaaaaacagaaagaggaagaaaaagcaaaagagattgaagtgacagaaaatgtggaagaggaaatcattgatataacagaagaagataaaaatcttgtatgggcttttaatgccggacaggctggaaatgattttcgtggtaatccgaaatatttatttgtatatgtaaataagtacagaaaagatattactgcttactggttaagtggaagtgaagaaaccacagagtatgtaagaaatttaggatacagagcatatactttagacacattagaagctgaccgggcaattgaaaaaacaggtgtacttgttgctgaacaggtaaaaatcggaattccaaagggaatgcgtcatgtgaaatacttaaatctttatcatggggttggagcaaaagatgttgaaagggtattaacaacaggtggtatggctgagggacttgctcataaatatattttgcataatcagtattatagagataatcagttatttttatgtccttctcctatgatggtagatgattttaaaagaatgtgtggagttgacgaagataaggttgtcagagctggatatccgagaaatatttaccagaaatattttgaaccgattactacatttgaccatgatattttaaaggcaaaagggttagatgaaagttataaaatagcagtatatgcaccaacataccgacaagcacttagtgaagatacatttcatatagctattccagatattgagaagttgatcgaagtatgtaagcgccagaaactgttatttgtttttaaaatgcatccagttatggagaatgaatatgcttatttaaaaatgaaagaaaaatatgaagattgtccatatttattattctgggataatagagatgatatttatgagattatagataaaatagatctggcggttattgactactcctctatttttacggattttgtcagcgcaggtgtatctcattatattcgttatgtatttgattatgatgaggctgtacaaggtctgaaccatgattatatggaggtaacaacgggagaattatgctatagtttctctgaattgctgcaggcgattaaaacgtataaagatagagatgatttgaagggaattgaccgcatcagtaatctatattggaaatactccgataaagattcctttgaaaaaattgttaatcagactttagaattcactccagttgaaagagaatttcctacactgtacagctttgatatctttgatactttaatttcaagaaaagtattagatccaaagggaattttctataaagtaaaagaagtgataaagaagagcgatttaaattatccagaatattttgtagaagaatatccgaaactgcgtatgtttgcagaagcggatgtaagagaatgctatcataaaacaatggaaagcagacattcagaacgtcgtgaaatttacatgaaggatatttttgataaactgcagtgggtatataatctgacagatgaacaggcagcatttcttatgaagtgcgagcaggaaatagagattgctaatacgattcctttaacagaaaatatcaataaagtaaagaagttattagagaataaggagaccgttgtattaatcagtgatatgtacctgcctaaggaaatcattgagaaaatgcttgaaaaggcagatccggttctgacacagattcctctgttcctttccagtgagtatggcgtacagaaaactacgagaaagttattcttagaggtatataagagctttaaaccattttatgattttggcaaatggattcatacaggagatggaagagtaccggatgttaatatgccacgccgtttaggcattgtagctaatcagattgaaaaacctgaatataatgaatttgaagggaaattaaccgagcagcttgatagctatgattcctatctggttgcagcattgatggccagattccgtcaaaaccatttatttgataaagaaaagtttgtatacagttatgtatcactttgctttgtcccttatattgattggctgttaaaggatgcgaaggctagaggatacgagacgttatattttgtatcaagagacggatatcatcttaaacgtatagcagacgaaattattaagatgaaaaatattgatataaaaacaaaatacatttatgcatcaagacgtgcatggagaatcccatcttttgtacatgatattgatgagggattctggtttagttatggaaattttgcaggtgttaccacttatgataagctgttgcaggctatgtctttatcagaagagaagtttatggaacttttccctaagttaagctacttgaaagaggaagaggaaattgagcctaatgaaaagaatcgtcttgtagagatattcaaaaactctacagaatacaaagaatatcttcttaatctggcgaaagaacaaagagtatctgtttgcggatacttagaacaggaaattgataaaacagaaaagtttgctatggttgaatattggggaagaggatacactcaggagaactttacatctctgtggaagacgattgcaggagatgatgcgaaatcctatttctattattcacgaacaatattagcttctgatgaagataatatccgttataactttacaacagataatgcatcacagttattcatagaggctatttttgccaacatgccatataagagtattgaatcttataaactggtaaatggaaaatatgaaccggttatcaataatatttcttatgataaagagttatttaacgctatggaaaaatatcttcttgaattcacaagaaattatgaagcattggatgttacagacagagaaaaattagaccggggattatataatttcattttagattattataagacctatcaggaagatgaaatatttatcaaggtacttgccccactggttgattctgtagcattatatggacagaaaaaagagtttgctcctgcatttacagcagaagatcttgaaaagatgaaagagaaagtgccaagaggtaagtttacaagaaacattcgtatttctgtagcaagatcctttaaaccagtacaggatgaatatagaaagatgtatcagcttaaagaaaccgatacacagggcggcggctatctcattcctgaaaaaacgatgcagagaaatgaagagtttgaacagaagatacagaaactgacggtggatcagattgaaaagcagaagatttataattctttagtttctgagaatccagtggaaaataagattctgtttatggcagatggtaaaaagataagctatacaggattctataccttaggaaaacttttagaagcacaagatacatttgttgttaaagaagttaaggcacaagaatatacaaacaaagaagatcttctgaaggaaatagcaacagcaagatttattatttgcttaaaaccattggtataccttgctatgatgacacttcgagaagagacagaagttatcgtacttggagaatctgcattcccatttattcatggaagaagaactacaataagaatggcaaagaaacctttagaatataaagaaatgatccaaaagcgtatgcatattgatcattttccaatcccttctttagagttaatgccggtaatatctgagatgtatggaattggagaaaaaaaagcctttgaaatgaaaggaagctgtcagacagacatatatttcaatgaagagtttatcaaagaatccaaagaaaaagtagttgctttattcccagaagcacaggataagaaagtaattctgtatatgccattattgcgaaacagaacggctgcaagtggttataaagaattactgaatctcgagcggctgaaaaaactcattggagataagtttgtggttgtatgtaatattcctcttccaaaaggacagtatatacagaatattgaaatagagggattctctaaaaatataacaaaggatatatctttaagagaagcggtaggtgcagcagatatcgttgttggagattacagagatacgatgtttgaggcagctcttatgagaaagccaatctttatgacaaattatgatgcagataaagtccttaaagataaagaacttgtttgtactatggaagaagtacaggttggaccgatggtagattctgaagaaaaacttgccgagcatttaagtaaattagatgagtatgattacagcaaacaggaagcattttgtaagaagtatttcacttattgtgatggaaagtctgcggagcgagttgcacagtatatagaatcggctaagtaggcactaatgatttttcaaacatgcttcagagcgtgtttgaaaaattcggagaacaagctgtacaatatataaaatttcctaaatggttctaagaattctctttaatttatgttaaggagaattctttttttaatttttttgaagaaaagtgttaataatgatgtataattgtaagagagaatggcttggaggagtaggagaatgaatatatttaaaaatttaaaaggacatttttgcacgattacccaccacaaaatgttagtaatgaaaacatgttttaaagtgggactttataagcagggacttcttcatgatttgtccaaatatacaccgattgaatttattccgggaattatttattatcagggagacagaagtccgattaaccgggaaaaggaattaaagaactgttcaaggggatggcttcatcacaaaggaaggaatcttcatcattttgaatattggattgattacagcattaatccgggcggcaagcttgtcggaatgaagatgccgaagaaatatgtggcagagatggttattgatcgtatcagtgccagcaaaaattatttaaaagaacagtataatgatggcagtgcgttggcatactatttaaacggaaggcatatgatgcttatagatgatgaggcggattatctggcaagatatcttcttacgatgctggatatgagaggggaggagtatttacttcactatatgaaacatacactgctccgtcataaaaatcgtgattatcatgtgagagatggaagactttatctggattaggtcaagatttcgttgcagttgacacggaatattgcatagaagctgtagtattgataaatattataatttttttgcggaatttatttatgttattaattaagtatatgtgatatgtttgtgcataacgtgtcgaaatataaaaagtaatatttttacaataaagtagataatttaatcttgaaatttaagagcaattacgttatagtatgtgtatactagcctgggatgttcgagaccccctgctattttgaacctacatttttgaacttgggaaactaaaattgttgaagggatggcaagcctccccttttgagaggaagtcagaagttcaattgaagttacccacctggctttggctaggactcaaaatcgcaggctacggcattttgggtgtatgctttatagccgtctcatgtgaatgaggcggcttttctttttttgattatagttgtggcatatggcttaaattatgaaaacattgtatgataaatcggctatgcgagatctgatttaaactatggagaaagttatgatgcgaagcagctatataaaagtatgaagttaaaaatataaagaggagaaagtatgccagcaagaaagaggattaaaaatttatacgaactggttatggatttcctgaaaaaatgcagtgatgatcatgtgggagcattcggggcgatgtctgccttttttatactcctttctatttttccatttatgatattcctgctgaccttaaccagatacattcctttttcaaaagatgacatcatagtgatactgacaagaatgatttcttttgaggaaggatcattaattaaaagtattgtaaatgaaatttatcgaaagacgggaactacagtatctgcgatttctatcattgcggcactgtggtcttcttcgcgtggagtttattctatcgttattggattgaattcggtgtacgatattgacgagaatagaaattattttgcgatacgtctatttagtctggtgtatacattactatttgcacttatgataagcgtcatgcttgtaatgtgggtatttggtaacagcttatatagttattttctccaaaaatttccttttgtagttccgatacttggatattttatgcataaaagaattatattttccctgatatttctcacgctgttatttatgataatttataaatggattccaaatagagtgtcgagttttcggaaacagtttccgggagctttgattgcaacacttggctgggtggcggtttctgtagggtgttctatttatatggataactttacaaatttctcatatatttatggaagtatggcaggaattatgattcttcttttatggctgtatttttgtatgtcgatggtcttttatggtgcagaagtgaattattttctggaaaataaagataattaccatttgcttatccgaacactccgtccgaactggcgtaagcagcaaagagcccagacagagaagatgcgccagaagtcgaaagatgagagagcagatcggaagaagaataaagcaaataaaaacaaagatgaaaatcagcaataatggataatagagtaatagaaggtagaaaaatgtatcatttagatgaaaaacagattcaggaaattacagattatatatttttagaagataaactcgaaaaggcagatgcaatctttattccaggctgtgccagaccagaacatacagaggaagcggcaaggctttataaagatggatatgccccgttgttattgccatcaggaggctacacgaaagtacaggggagttttcagggtgtttcaaaagaagggcagaaatacggagcagattttgcttgtgaggcagatttcttagaggcagtcctgatacagaatggagttccggcttctgctattttaaaagagtgtgaggcaacctatacattagaaaatgcggaaaaaacaaaagtcctgcttgagaagaaagatatccatttgaaaaaggcaattctttgctgcaaggcgcaccattccagaaggtcgtatctctattactcgatggtatttccagagatagaaatattggtgtatccagtagtggtagatggcatttccagagaagactggtacaagacagccgaagggagaaaagttgtgctgggggaattttcgagaatggggcagcagcttttgatgatggaagggcgaattgcatgggattaatatactattgaagtctttctcgtacttgtttttgtagctgatttttcgccagaacatttttaaacatgctctaaatgtccttgaatttgattaatgttagagagaaattcaggatagctcttgacattaatttttccctgcgttacaatgttattcattgaaaaagcgttgaaagtggggcttttgcccacagtagaagtatgatgtaccgttagagaaggaggatcatcggctggaagttctccgaggctccgttatatttcgaatttccacactggagctgcatttcggagactgattcgtaatcaggtaaggaatgtcgtatgcgcacgttacgcgtgaatgagagcctgaataacatttagtatattcaggaatcagggtggtatcgcggatttattcgtccctttttaatttcggttaaaaagggacttttttatgttataaatagtttatcaacttacctgctttttataacataaagatcatcagataaggactatcagagtagagatatagtttttataagtttgttcaagtcatatgtggctgttcagactttgagaattactgactgtaaatttggaatacggaattctgaatagctcaagtttaataaagaaccgttatcatcatttaccaaagtaaattaatttaaaaataaaggagtttatcatgaaagagaaaatcgagcagattcgtcagcaggcacttgctgcaattgaagatgcagcaggcattgacaagcttaatgatgttaaagttgctttccttggtaaaaaaggacagttatccagcctgttaaaaggaatgaaggatgttgcaccagaagacagaccaaaggtaggtcagatggtgaatgaggcacgtgccggtatcgaagcaaagatggaagagaagagaacagctatccagaagaaacttcgtgaagagaagatgaaaaaggaagttattgatgtaactttaccaggtaaaaaggtagcagtaggacatcgtcatccaaaccagattgcattagatgaccttgaaagagtatttatcggtatgggttatgaagtagtagaaggccctgaagtagagtatgaccactacaacttcgaactgttaaatatccctgcaaaccatcctgcaaaggacgaacaggatacattttacattacaaaggacatccttcttcgtacacagacttccccagtacaggcgcgtatcatggaaacaggccgtatgccaatccgtgttatcgcaccaggacgtgtattccgttctgacgaagtagatgcaacacattccccatctttccatcaggtagagggacttgtagtagataaaggaatcacatttgctgacttaaagggaacattacagcagtgggcagaggaattctttggaccagatacaaaggttaagttccgtccacatcatttcccattcacagagccaagtgcagaggtagacgtatcctgcttcaaatgtggtggaaaaggatgccgtatgtgtaagggaagcggatggatcgagattcttggatgtggaatggtacaccctaaggtattaagcgattgcggaatcgacccagaagtatattcaggatttgcattcggaatcggtcttgagagagttacactcttaaaatatgagattgatgatatgcgtctgttatatgagaacgatgccagattccttaagcagttctagagcgtgttgaaaagttatttcatcaatcagcagaaagaattattcaaatattttttagtaagaccgagaaacctaattcgatgaaatgtaaaaaggttaacatgatgagaaactagaattatctcggtaagataaattcaaaatatatttaagtttatagatataaaaggagacaaaaatgaatacaccaatttcatggattaaagcatatgttccagatttggattgtactgtacaggaatatgtagacaagatgactctgtctggttcccacgtagagaatgcagtataccttgataagaatctggagaaaatcgttgttggacgaattgaaaaaatcgagaaacatccagatgcagataaattagttatctgtcaggtaaatgtaggtgacgaggaagtacagattgtaacaggcgcatctaacgtatttaagggagctatggttcctgttgttttagatggcggacgtgttgcgggcggacatgacggaagcccaaatcctgaaaatggaattaagattaaaaaaggtaaacttcgtggagttccttcttacggtatgatgtgttctattgaagaattaggaagcactcgcgatatgtatccagaagcaccagaagacggtatttacatttttgatgagagcaaagatgtaaaaccaggtgacgatgcagtagcagcattaggacttcgtgatgcagtcgtagaatttgaaattacttctaatcgtgtagactgtttcagcatgattggtatggcaagagaagcagcagctacatttgaaaagccattctatgctccagaagtaaaagaagttggaaataacgaaaaagcagaagactatatctctgtagaagtagaagctactgatttatgtccaagatacacagcaagaatcgtaaagaatatcaagttagctccatcgccagaatggatgcagagaagacttgcagctatgggtatccgtccaatcaacaatatcgtagatatcacaaactacgttatggaagagtacggacagccaatgcatgcttatgacttaaataagatcagaggtcataaaatcgttgtaaaacgtgcgaatgacggtgatgtatacacaacacttgacggacaggaaagaaagcttgataaagatgtattaatgatcaacgatgcggaaggtcctgttggtatcgctggtatcatgggtggagaaaactccatggttacagatgatattcagacaatgctttttgaggcagctacatttgatggaacaaatatccgtctttcttctaagagaatcggtcttagaacagatgcttccggtaagtttgaaaaaggtcttgacccagagaacgcattagaagcgatcaaccgtgcctgccagttagtagaagagttaggtgctggtgaagttgttggtggtgttgtagatgtatatccaaatccagtagaagacgtaaagattcctttcgagccagcaaaatacaataagcttcttggaacaaatgtatctgaagaaaagatgatggaatactttgaccgtcttgaaatcggttacgacaaagaaacaaatatgttactcatcccatctttccgtcaggatttaagatgttctgcagatatcgcagaagaagtagcaagattctttggatatgataacattcctaccacacttcctcacggcgaggcaactgcaggtaagaagtcatttgctgcaagagtagaagatgttgttatgaacatcgctgagcagaacggattctgcggcggaatgtgctattcttttgaaagccctaaagtatttgacaagttacttcttgctgacaacgacccattacgtcaggcaatcgtaatcgcaaacccacttggagaagattacagtatcatgagaacgatcgagttaaatggtattttaacttctttagcaggtaactataaccacagaaataaaaatgttcgtctctacgaaatcggtaacgtatatcttccaaaggctctgccattaacagaacttccagacgaaagaaagcgtttaactctcggtatgtacggcgagtgtgacttcttcatgttaaaaggtgttcttgaggaaatgttcttaaaacttggtcttgacggcaaagttgacttcgagccatcccaggaaaaacctttcttacacccaggaagacaggcactcatttatgtaggcggagcttatgccggatttatcggacaggtacatccagaagtatgcgaaaactacgacatgaagtgtgaagcatatgtagcaggaatcgaccttccaactgttacagaaaaggctactttcgacagaagatacgaaggcgtagcaaaataccctgcagtaaacagagacttaagtcttgttatgaaaaaagatgttttcgtaggaagccttgaaaaagtaatgaaagaaaaaggcggcaagttattagagagcatccagttatttgacgtttacgaaggttctcagattgaagaaggatataaatccgttgcattcagccttgtattccgttccccagaacgaagcttagaagctgctgaaatcaacaagatcgtagataagattcttaaagaacttgaaaaaatgggagttgaattaagagcatgatgaaaacaagtgattttaattttgatcttccacaggaactgattgcccaggacccgctagaagaccgttcctcatcaagattgatggtgcttaacaaggaaagcggtgagatagctcaccgtattttccatgacattacagagtatcttcatccgggagattgtctggttatcaacgacacaaaagttatcccagcccgtcttatcggaacaaaagaagataccggagcccacattgaaattctgttattaaaaagaaaagaaaatgatgtctgggaaacacttgtaaaaccgggcaagaaatgccgtccaggtgcaagagtagtctttggaaatggagaactgaaagctgaaatcgttgatgtattagaagatggaaaccgtcttgtacattttgaatatgaaggaatctttgaggaagtattagaccgcctcggtcagatgcctctgcctccatatatcacacataaattacaggataaaaaccgttatcagaccgtttacgcaaagtatgaaggatccgcagccgcaccgacagctggacttcattttacaaaagaactgttaaaacagattgaagatatgggcgtaaatatcgcccgcgtaactctccatgttggacttggaactttccgcccggtaaaagtggaaaatgtactcgaacaccatatgcattctgaatactataacgtaacagaaaccgcagcgaaaatgattaatgacactaagaaaaatggtggcagaatcatcgcagttggaacaacaagtacaagaacacttgaatccgtggcagatgagaatggaatcatccatccgggctgtggtaacacagaaatcttcatctatccgggttataaatttaaggcaattgactgtctgatcacaaacttccatttgccagaatctactttgttaatgcttgtatctgcactggcagggaaagagcatattatggcagcgtataaggaggcagtgaaggaaagatatcgcttcttctcttttggagatgcgatgttcattcaataaattctgatttgcgcagcaaaggagacgctttcaaagagagccgataccctatatttgtgactttagtcgctgcaggttgaatgttcgcttaaccgcttgcatccaacctttgctccgaggccacaaatatatggtatcggctctctttggaagctgtttgttggctgtccatgcaaattcagaatttattttgagaaagatttgagggaggtggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaggcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccaaggcttcagacagttgtgaccttttgaggaattgaaataatggaggactgacacttatcttatcattttaaattatttgatattataactatctttggaagatctctgggatttagccatttgccttataacttttttgctttctttagcatttttatcacaaatgaatttgttttttcaaaaaacaaattcataaacacgctctagttaatagaaaaaagtagtgaccataaataactatacgattatggcactggttcaagtgtcaatcctatagaatttcatttaccttcaggagttcgtctgctccgtagcctgacaaatcagaatttttaaattatttttttttgctaaccgaatggaggcaatattatttttctctattctggtaacaattttcgtgaagcctaaatattctttgccgaagtgaatcagaggaggaagaatttctgaggcgattccttgttgctgccatttttttagaacagagtaaccgatttcggcagaatattcattaaaatcgttttcgggatatttttcggaagttttttcggaacagtgctcagaaatatttttgctttttttctcgggaattttctctgacaaattctcagaaattttaaaatttttttcttttgagtttagggtgtctgaagttattacattttcaaatggtgaaaaaccggcaattcctaaaaaagtctcattttctttgttgaagattccataaattccatatccataaaatgcatattgattttttatataattttgaagaaattcttcggcttctgcgtatgtggtacagttttgtggaaagaagcagccggaagggttgtttttattttcttcttgaagttgcagaagttcagggagttgcctggtggtgagttctcggatgatgcagcggtttgtggtggttatagttagaggttttttataatgtctgcaatacacttcatttaagaaaaatggactgagtccatctgtatctaaaatcagccacggggtccccatcagggattcttgtctgttatttttgtgtgaaaatgcgatgacgggaaggttgtgtttttttgcaagttcgatgtttttgtcaaggtcacataaaataagcgaaaaatctgggaaatcagtcaaggcaggaaactctttagaaattatgaaatttatggtatagttaaaatattctgaggaaaaattccgggcaatattatttccctggatttcgtccataataataaaaaagttaaacataacagaatacctttcattttatttttgtatattcttgtttatcatacgaaagaaaagaaagattgtaaaggatatctgttttggaggtaaacaatgcgaaaggaagagaatacagaaaaagatgagctgtatggcaagctgcaagttcattttatagagaatgtagaggctgaggaatcttctgaagaaaaagaatcggattccggaaatctttctgatgagacagctagaaagtctgtatcggcagaaaaggagaatagagcaaagaagccagtacaaaaggatatagaggaggcatcggccaaatcaaaagggaaaaagtcagagacccaatcagatagttcccaaactgatagcgaagatgatgtaaaagaacaaaaaggcagccgaaagcgcagacatagcaaggtagataagcaggaggcagaagctgttgaggaatctttttataaggtaacaggtgaggcagaggaacataagtctcaccctgttagaaatgcaatattaggattattagtcctgattcttgtggcaagtgcggttgtatcctacccaataggaaaggaatattttcaggaaaaatccgtagcaggcaaggatattgaaatcacgattgaaaagggaagtacttcaagagatgtaagtgcgattcttaagaaaaaaggtatcattcgatacgaggcagcatttttattgaagctatatttctctgattataaaggaaagcttcgctatggaacatttgatttaaataatggaatgagtttgggtaaagttatcaaagaactggcaacgcaggatggtcaaaaagagaataaattcaccattccagaaggatacacgattgagatgacggcaagcaaactcgaaaaagaaggaattatgtccgcccaggaattccttactgcagtaacgaatgcagctgtgacatcaaagtataaagatgtccttccgaaaaagaaaaaagtattttatcagttacagggatatatttatccggatacctattacttagcgaaagatattaccggtgatcagcttgtggcaaagatactcgatgaatttgataaaaagttcgatgcgacaagacaggaaaaagcgaaaaagcttggtatgacagtggaagaagttctgattcgtgcatctcttttacagaaagaaacagaacttccggaggaatatccaattatcgcaggcgttattcagaatcgtcttgataaaaagatgaagttacagttcgattccactgctgtatatgctattacaaaaggccagtatggaatcgcacgagtaatgtataaagacttaaaagtggattctccatataacacatataagcataaaggcctgccagttggaccaatatgtagcccaagcttagaagcgattgatggagtgttgaatccacagaaaaatgattatctgtatttccagatggatacagtgaagaatgatggctccaatattttcagtaaaacttatgaggagcataaggcggcttctgcgactacagaagcggcaacagaaaccacaacaacggctgtgaaacaaaaaacaaagaagaaataaagccctgatttgttgagacaaaacggacgcccgaaaagagagcctatcccctatatttgtgactttagtcgcggcggtttgaatgttcgcttaagcgctcgcatccaaaccttgctccgaggccacaaatataggggataggctctcttttcgggctgactgtggtcgctgaagtaaaatcaggattcatattgggggatttgaggattctccggaaagttgcgatttttttgtaatcgtttgttgctttctgtagttaaaaagagaggattgcaagaatattctgcataaaaagtaagaaaatagaaataatattcaaagttaaagtgtgatagtatagctatcgaattgagtgatatttataggactagagaagttgagacttaaaaggagaacataatgaagtgcttagattgtggaaatgaaatgcaacaaggaatagttgaaggatatggacagggcggacattcctgttatgaatttacatctgatgaagaaaaaaagaagaaggggttgaaagggttttttactaaagaaattattagtatctctacagacaatatggagcattgtgcatggtattgttcaaagtgtaaaaaagttttaatgtggatggatacggatgagtaaagatgatttacaaaagaatttcaagaaatctgatttgggaaagagttcaattcagagtgtgaaagcttttacgtttatagaattaatataattgcagatttaagaaaaacagagtccccgaaccctagcatctgcaaaaatgcgccttagagcaaactcttaatgcgggtgagcattaagagtgcagtgatatgaagcatttttgcagatgctagggttcggggactcgtctgtttatctcaatcctacaacttagaatttcttctcgtattcttttagggcttgtagagcctttttcgacaacggatataacataatgatgttaaagatcgtcatcaacccaattccgacatctcccaaatcccatacaattgtatacgcagcaagtcctccaacaaaaagcattgctaaagcaagaactttgtaagctgtttgagagaaccagttatctccaaagaggtaagctacgttggagcgtgcataaaacaagattccgataaatgtagaaaaactgaataaccataacgttatggcaatgaatattactccgaatgagccgagatgatattccattgctttttgtaataaatccattccaacgagtccttcagtgagctttgttggagtaaggagcatgatcatagcagtacaactgcagatcataagcgtgtcaataaaaacgcctaacgcctgtgttaatccgactttaacaggattatctgcaacagcggctgcggctgcgcaaggggcagaaccagaaccggcttcgtttgaaaaaaggcctcgtttgattccattcataaggacggcaccgaatcccccggcggctacctgacggaaaccaaaagcttcagaaaagattcgttcaaatacaccagggagctgtgtgatatttgtgatgataataaacaatgtaatcagtaaataaaatccagccatgatgggaacgataatatccaaaacttttacagttgcattttttcgaagtacgataattgcggcaagtattacaagaataactgtagtgtaaatcggtggaatgtgaaaagcatttttaaaagcagatgctacggaattacttactacctgactgatgccgcaccagcatataaggccggaaatggcaaagagtacggaaagaagtacataacgttttttcttgccggatttttcttcaaaatatcgatgaatgtagtaagcaggtcctcctcgatatcctccatatagagggtctttttctttataaatctgtgataaagttgcttcgataaaagcggtggaagaaccgataagggcagtaacccacatccagaaaacagcaccagctccgccagcggaaattgcggcaactacaccgaccagattgcccattccaacacgagttgctgtggaaacaatcaaagtctggatgacggaaagtgcgctttgttcttcgtcttttttttcgaaaagtgcgccaaccatatctttgaagagacgtattggcagaaactttgtacggattgtgaaatacactccggtaggaattagtaaaatgactaaaagtgaaagggggagtgttccgccgccgggtaagggtgcggtgagtaaatctccccataaaaaattgtatactgtttcgattaatttgaccatattaatttgtatcctcctgaaggtagtatataatttctttttaattttgtaaataaatagttgactctagaagaaaaatggtataaaatggaaaaacaaacacataaatggaataaaataacttaaatagaaatttaatacttttaaaagttcaagagaaaataatgaaagttatttaaaaaattatttttgagtcaagttaaatctgtcagttggaatggtttatagattaaacacatgttaataactccattgcagggattttcataattatagtatttggggttacagggtctgtaaaatagtaaacttaataaaaattctgcaattagcaggagccagggggagtatatgagggtaattacaatgattgttatagttagtattttactggttatttctataattgattttaaaatcaagataattccgaatcagttaaatgtacttttgtttatttcaggaatctggagtggttttgttttccaggaagttacattcttaagtcgctttttgggagtgttttcggttagtattccgatgttcatacttgcaattttatgttcaggcggactgggtggaggagatgttaagctaatggcggcaagtggagtgttactagggataaagtggaatatatttgctgcttgtgcgggattacttttaggaggattatatggattttttctgctgattacaaagcgtgcgaagcgaaaggattgctttgcgttgggaccttttttgtgtatagggattgctgttgtgttttttagatatatttttatgaaagtgtgagggagctgatatggaattaccgtggatttccacttaattttcttttcatcacttctgagtaaaaagtcgtttttcgtgaattgtctcattgacattttgtcaaataacgtgcctgttttcctatagagttgtgttggcttcattcagttgacgtagccgcccgttacgctgccttcattcaggcaaaatctcccgcaaattgtgacacacatcttgcagaaagcatttttcaaacacgttccagttgattaaattatgtaaaattacgaaattgttatttttaaaagatggagataaatggtgaaaacaaagaggaatctcataaaataattaaaaaaatgaagaaaaaatattagaattttaatcctgaataatcctaaaattacaacaaaaaattattgagaaaaaatctaaaataagccatatgtatattgtatacaaaactgttggttttatagcaattttaacctaaaattgttctcggaaaaatacgttgtcaaggggaaaaattggcataaaaaggctgtttcgggcaagattttgtattttagaaggaacagttccgaataagctttacattacctcaaaaaaatgataatattatgtcgaatttaaaataaaccacaacttttgacaaggaggaataatcaatgcctagagcaaaacagtctatggatggaaataccgcagcagctcacgtagcatatgcgtatacagatgttgcagctatctatcctattacaccatctagtccaatggctgattccgttgaccagtgggcagcagcaggacaggaaaatatttttggtaaccaggtagttgttagtgagatgcagtctgaggcaggtgcagcaggtactgttcacggttctcttgcagctggtgctatcacaacaacatttacagcatcccagggtcttcttcttatgatccctaacatgtataagatcgcagctgagcagcttccatgtgtatttgatgtatctgcacgtacagttgctacacagtctctgaacattttcggtgaccacagtgacgtatatgcatgtcgtcagacaggatttgctatgctggcagaaactaacccacaggaagttatggacttaagccctgtagcacatcttgctgcaatcgaaggtaaagttccattcatcaacttcttcgatggtttccgtacatctcatgagattcagaagatcgaaaaatgggattatgcagacttaaaagaaatgtgcaacatggatgcagttaaagctttccgtgagcatgctcttaacccagaacacccagctatgcgtggttctcacgaaaacggtgacgttttcttccagcacagagaagcttgtaactctgtttacgaagctttaccagctgttgttaagaaatacatgggcaaaatcaacgaaaaactgggaactaactacgatttattcaactactatggtgcagaagatgcagaccgcgtaatcatcgctatgggatctatctgtgacgtagcagaagaagtaattgattacttaacagcaaaaggtgaaaaggttggtttaatcaaagttcgtttatatcgtccttgggtatcttctgcattattagatgttattcctaagacagctaagaagatcgctgttcttgaccgtacaaaagagcctggagcattaggagatcctttatatcttgatgttgctacaactcttagagaagcaggtcttaacgatatcgttcttacagctggacgttacggattaggttctaaagatactcctccttcatctgtatttgctatttataaagaacttgaaaaagatgctccaaagagccgtttcacaattggtatcgtggatgatgttacaaacttatctttaccagaagttaaaccagctcctatcacatctgctcctggtacagtagagtgtaagttctggggtcttggtggagacggtactgtaggtgctaacaagaactctacaaagattatcggtgaccacacagataaatacattcaggcatacttccagtatgactccaagaagacaggtggtattacaatttctcaccttcgttttggtgacaatccaatcagaagcccatactacattaatcaggctgacttcgtagcatgtcacaacccatcttatgtagttaaaggttacaagatggttcaggatgttaaaccaggcggaatcttcatgatcaactgccagtggtctgatgaagaattagatcatcatatgcctgcagcagctaagaagtatattgctgacaacaacattcagttatacacaatcaacgcgattgataaggctatcgagattggtatgggtaaacgtactaacacaatcttacagtccgcattcttcaaattagcgaacatcatgcctatcgacgaagcagtagaattcatgaaagcagcagctaagaagtcctacagcaagaagggtgacgctgttgtagagatgaactacaaagctatcgatgctggtgtagatgctgttcataaagtagagattccagcttcctggtctaacccagctgctgatgctcctgctaaagaacttacaggacgtccagagacagttaagatggttaaggaaatgatggaacctatcggaatcatggatggtgacagcctgccagtatctacattcgtagacaacgctgacggacagttcgaacttggtgcttccgcatacgaaaaacgtggtactgctgtatctgttccagaatggaatccagaagcttgtatccagtgtaaccagtgtgcgtttgtatgttcccatgctacaattcgtcctttcttagtaagcgaagacgaaattaaggcagctcctgacaacatgaaagttgcagatacaaagccaaaggcaagcgaatacaaatttacaatgagcgtatctccattagactgtatgggatgtggtgagtgtatcacagtttgtcctgctgcagctaagggcgcattaaagatggttccacaggaaagccaggcagcagaacagccagtattcgattacttagttgcaactgttggaagaaaaccaggtgctcctgcagatactacagttaagggatctcagttcaaccagccattacttgagttctccggatcttgtgcaggatgtgcagagacatcttacgctcgtctgattactcagttattcggagagcatatgtacatctccaacgcaacaggatgttcatccatctggggtggtcctgcagcaacagctccatatacagtaaacaaagattccaaacagggaccagcttgggcaaactccttattcgaggataacgcagagcacggctttggtatgtatcttggacagaagactttacgtgaccaggctatcgctaaattagagaagatggcagcatccgataaagcatccgatgaatttaaagcagcatttgctaagttcatggaaacaaaagacaatacaaaagaaaatacacctgatgctcaggcattaatcgctgaggtagaaaaagcagcagcagctggatgcccagatgcagcagaagtattagagaagaaacagtatctcgctaagaagtccgtatggatcttcggtggtgacggatgggcatatgatatcggtttcggtggattagaccatgtattagcttccggtgagaacgtaaacgttatggtattcgatactgagatgtactccaacacaggtggacaggcttctaaagcttctaacatcggtgaggtttgtcagttcgcagcagctggtaaagaaatcagcaagaagagccttgcagagatcgctatgagctacggatacgtatacgttgcacagattgctcttggtgctaaccctaaccaggcagttaaatgtcttgcagaagcagaagcttacaacggaccatccctgatcatcggatacgctccatgtgaacttcacggtatcgctaagggtggtatgaaccactgccaggatgagatgaagaaagccgttaaggctggttactggaacctcttctccttcgacccagctaagaaagctgaaggaaagaatccattcacattaacatctaaagaaggcgacggatcatatcaggaattcttaaataacgaatcccgttacactcgtctgattaagccattcccagaaagagctgaaagactcttcaacgaatctgagaaggttgctaaggctcgttacgagcacctgcagagactcgttgagctttataaataataaagcctgaactggtcagtcagattagttacaaaagataaaactttataaaatataaaggagaagccgtgtgctagctatgctggtgcatggcttcttcttgtgtgctggagtatttttagtctttgttgaaaaaaggtgccaattatattataataagctataataaataataaccgatagatagaatcgggctggcttgggaaagggcagtaatgttgcataaagaagattttggagaaggaaaaaatatagaatttaaaagagaaatacccaaaaggcatgagaattttttaaaagatgttattgctttttccaattctacgggaggcaaaatttttattggaattgaagataagacgaatgaagtcattggcattggagagaagaatccttttaaattagcagatgatatttcaaatatgatatttgacagctgtactccaataattgatccggaaattacagtacagaccttggaaggaaaaactcaaattataaataaaatgacaattgaaaaattagaagacctagggttactatgtcgaataggaaaagaacttcaaccgactcatgcgtttagactcatgacgaagaataaaatacgttatgccaaaattcaatgtgcgttatttaaaggaacagaaagagatatttttattgataaaagagaatttgatggaccgttgtattcacagttagaaaatgcttatcaatttgttctgaaacatattaatcttagtgcaaagatagaagggttgcatagaaaagaatcgtatgaactcccagttcgaacaataagggagttgattataaatgcagttgttcacagaagttatttggatgaatcctgtatcttcgggcgaaaagaaataaaacaagggttggggtataaagacagtaaggctggatttttaattcagataatgcaagaatttgagttaattaaaactgtgaaaggacgcggcaagggaaagtatagatttgccatataactctgaattgcgttgcaggcgaaattcactttccaaagaaaactttctccacttaattttcttaagttatcctgtatacaatattaataaaatgcaggatttgatattaaaaactacatttataattgtacgaattgtattcaaacctaaaaataacgatgtataagcaaccaaaattgcaaacaaaattgtatttttacaagaacaataagttctaaaaagaacaaaaaaccaataaaataactacaatatcccccagaacaagaataataatcagaaaataatctatttgaaaataaataatcaaattattagacaacttgctctaatgtttatgtttacaacccatttaaaatgttgtaatatgataacaacaaaaagaaatgcaggaagttattaaaactgcttctgaaaatgaatttgttacttttttaaatatgtgattattcagagacctatagattttttcagactatagatatttattcagaatcatgagattataagatcacaagagcatgagaattataaggtttgattaagagttcctgataattactaattacaaaaatataatttacaactgatgaatatttactatttcatagtgatgcaagaaagggtgagaccatgtatcaggacaatatgcgacagggtctatatgatccaagtctggagcatgataactgtggtattggtgctgtagtaaacatcaagggtcttaagagccatgagacagtatcgaatgccttgaaaattgttgaaaatcttgaacatagagccggcaaggacgccgagggtaaaacgggtgacggagtaggtatcttagtgcagatatcccataagttcttcgaaaaaacctgtagtactctcggcttttctattggcaaggaacgtgactacggtattggtatgttctttatgccacaggatgagttacagagaaaccgtgctaagaagatgtttgagattatcgttgaaaaagaaggcttaaatttcttaggctggagagaggttccggttcagccgggcatcctcggaaagaaagcagcggactgtatgccatgcattatgcagggatttgtaaagagaccgtttgatgttccacgaggacttgacttcgatagaagactttatattgtaagacgagtatttgagcagtctaacgattctgcttatgttgtttctttaagcagcagaacaatcgtatataaaggtatgttcttagttggacagttaagattattctataatgaccttcaggataaggattatgaatctgcaatcgcattagttcattcccgtttctccacaaacacagttccaagctgggagaaagcacatccttatcgttacatcgttcataatggtgagattaatactattcgtggtaatgccgataagatgttagcccgtgaggaaaacatggaatctgattatctgaaggatgagatgattaagctgacaccagttgtagatccaaacggttctgactctgcaagattagataatacattagaattcctcttaatgagtggaatgccacttcctctggcaatgatgatcacgattccagaaccttgggaaaataacgagggcatgagcagagagaagagagacttctatcagtactacgcaacaatgatggagccttgggatggtcctgcatctatcctctttacagatggagatatcatgggagccgtacttgaccgtaatggtcttagaccttcccgttactatattacagatgatgaccagttaattctttcttctgaggttggtgtgttagactttgacacaacacatatcgtaaagaaagagagacttcacccaggtaaaatgcttctcgtagatactgtaaaaggtgagctgattgacgatgaaatcttaaaagattcttatgtaaagaatcagccttacggtgaatggttatccgataaccttgtattcttaaaagacttaaagattccgaatgttgcagtagaagaatacagctatgaagagagcaaccgcctgatgaaagcatttggttactcttatgaagaagtgaaagattctgtattaccgatggcattaaacggaagtgaagcaatcggagcgatgggggttgatactccattagcagtactttctaagagacatcatccattatttgattactttaaacagctttttgcacaggtaacaaaccctcctattgatgcgattcgtgaggaaatcgttacatctacttccatctatgttggcggagaggggaatgtgttggaagaaaaggcagaaaactgccatgtattaaagattcacaaccctattttaacaaatacagacttattaaagattcgttatgcaaaggtaaagaatatcaatgtaaaagatgtgccgattacttattacaaaggaacaccgcttgataaggctatcaatcatttatatgttgctgttgaccaggcgcataaaaatggtgcaaatgttgttattttgacagatagaggtgttgatgagaaccatgtggcaattccatctctgttagcagtatctgctgtacatcatcatctcattgagacaaagaagagtacttctgtaagtattatcttagagagtggtgaaccaagagaagtacatcatttcgccacactgttaggttacggcgcatgtgctatcaacccatatctggcacagttcagtattaagaagctgattcaggatggtttattaaagaaagattactatgcagcagtaaatgattacaataacgcagtacttcacggtatcgtaaagatcgcatctaagatgggtatttccacactgcagtcctatcagggttctcagatttttgaggcagttggtatcagcaagaaagtcattgatgagtactttacaaacacagtaagccgtgtagaaggtatcacaattgaagatatcgcagaagatgtagattaccatcactccaaagcatttgatatgttaggactgaaaaatgatcttagtcttgacagtgaaggtgatcacaaatatagaagtggtaaagaagaacatctttacaatccactgaccatccatacattacagacagcagcatggacaaataattatgaactgtttaaacagtatacttccatgattaataaagaaacttctccagtaagtcttcgtggattaatggatttcaattatccatccaaaggagttcctatcgaggaagttgaatctgtagattctatcgtgaaacgatttaagacaggtgctatgagttatggttctatttccaaggaagcacatgagactctggcaatcgcgatgaacatgattcacggtaaatcaaacactggtgaaggtggagaagatttagagcgtctgacagttggtccagatggactgaataaatgctctgcaatcaagcaggtagcttccggtcgtttcggtgtaacaagccgttaccttgtaagtgcacaggaaattcagattaagatggcacagggagcaaaacctggtgaaggtggacatttaccagcaggaaaagtatatccttggattgcaaagacaagacattcaacacctggtgtaggactaatctcaccaccacctcatcacgatatttacagtattgaagatttggcacagttaatttatgatttgaaaaatgcaaacagaaatgcccgcatttctgtaaaactggtatctgaagcaggtgtcggaacggtcgcagccggtgtagcaaaagctggcgcacaagtaatccttatttccggacatgacggtggtacaggtgcagcacctcgtaattcttctatccataatgccggacttccgtgggagcttggacttgctgagacacaccagacattaattaaaaatgaccttcgtaataaagttatcatcgagacggacggtaagcttatgagcggccgcgacgtagcaatggcagcagcacttggagcagaagaatttggatttgctactggtccgctgattacaatgggctgcgttatgatgagagtttgtaacttagatacttgtccagtaggtatcgcaacacagaatccggaacttagaaaacgttttaaaggtaaaccggaatacgttgtaaactacatgaagttcgttgcacaggaaatgcgtgaatacatggcaaaacttggtgtccgcactgtagatgaactagtaggacgtacagaccttctgaaagaacttccagaagcaaaagagtaccacttagatttatctgctattttaaataatccatatgtagataagaagcatccaatctgctacaacaagaagaatgaatacaactttgaattagaaaagacattagatgaaaaagttcttcttactaagttgaagacagcgcttgataaaaagcagaagagaagcatttctatcgatgttggaaatacagaccgttcctttggtacaatctttggttctgaaattacaaagaaatattacaacacactggaagatgatacatttactgtacagtgtacaggagccggcggacagagctttggagcatttattccaaatggtcttacattagagcttgtcggtgacagtaatgactacttcggaaaaggattatccggtggtaaattaatcgtttaccctccaaaaggaatccgcttcaaagccgaggaaaatattatcgttggtaacgtagcactttacggtgcaacaagcggtcaggcttatattaatggtgtggctggtgaacgtttctgtgttcgtaactccggtgcaacagctgttgtagaaggtgtcggcgatcacggatgcgagtacatgactggtggtaaagtcttaattatcggtaagactggaaagaacttcgcagccggaatgagcggcggtgttgcctacgttcttgatgaggataacgacttatacttaagcctcaacaaggaaatggtttcttccgaaccagttgtttctaaatatgatgttatggaaattaaggatatgattaccgcccatgtggcatatacaaactctgaaaaaggtaaagaaatcttaaatgattttagcaaatatttaccgaagtttaagaaaatcattccacacgattacaagaaaatgctcaagaagatttccgaaatggaaggaaaaggtcttagcgcagagcaggcacagattgaagcattttacgaaattaaaagaggataggaggagagcgctatgggaaaaccaactggatttttagaatatgaacgaaaagaaagcgtgggagaagcgccgttaaagagaatcaaacattttaacgaatttcacactcccctgtccaaaaaagaacaggagagacagggagcaagatgtatgaactgtggagttccattttgccagtccggtattttgattaaaggaatggttaccggatgcccgcttaataatctgattcctgaatggaatgatgcaacttacacaggtaactgggatgaagcttataaccgtcttagaaagacaaatccatttccagaatttacaggtcgtgtatgtccacatccttgtgaagtcggatgtacctgtaacttaggcggggatccggttaacatcaaagaaaaagagttaagtattatagagcgagcttatgaaagtggcctgatcaaaccggagccaccagaagtccgcacaggaaagacagttgctatcgtaggttccggtccatccggactctgcgtggcagaatacttaaaccgccgtggccattctgtaactgtttacgagcgttccgaccgtgttggtggactgctcatgtacggaattcctaacatgaagcttgaaaaaacatatattgagagaaaagtaaagctcatggaaaaagaaggcgttgtattcaagacaggcgtaaacgttggtgtagacgtaaaagcacaggacttaaagaaacagtatgatgctgttgtgctttgctgtggagcctctaatccaagagacatcaaagcaccaggcagaaagagcaaaggaatttattttgcagtagattacttaaaggcagcaacaaagagccttttagattctaacttcgcagataaaaaatacattgatgccaaagataaaaatgtcatggttatcggtggcggtgacacaggaaatgactgtgttggaacatccatccgtttaggatgtaagagcctcattcagttagaaatgatgccaaaacttccagatgaacgtcagccaaataacccatggccagaatggcctagagtctgcaagacagactacggtcaggaagaagctatcgctgtatttggcaaagacccacgagtatatcagacaaccgtaaaagaattcattgccaatgaaaaaggcgaagtctgcaaggcaaaactcgtaaaacttgaaagtaaattcgacaaaaaagccggaagaaatatcatggcagaagtcgctggcagcgagtatgaagtacctgttgatttggtattaatcgcagcaggattcttaggaagccagtcatatgttacaaaagcttttggcttagatcttacagaacgcacgaatgtaaagacagtagaaggacatttcaagacaaatgtagataaagtctttactgcaggtgatatgcatcgaggacagtcacttgttgtatgggcaatcagggaaggtcgcgattgcgcaagagaagttgataaagccctgatgggatactcaaatctgtaacttctggtttgccgcaggcaaagagacgctcgcagtaaataaaagaacctatatttgtgactttagtcgctgcggtttgaatactcgcttatacacgctcgtatccaaaccttgctccgaggccacaaatataggttcttttatttactgtgagctgtctttggctgctgaagtaaagtcagaatttatgttttaaaagatttggggattttttagaagtttgtggattgctgaggaatcaaacttgaaaggactgacattcaaactgttatcattgtgttacaataataaactaagtttcaaacacgctctaatacatatgcaaatcaaacttgttccactacagcatttctcatgctaatctcaataaaatatggctaaaattcagtgcttttcacatctattttcgtatcagtccactaaaatttaattgcctggtatttttatattctctgtattcttccccaaatcttttaattgatttgccggattagaaatagacagccgtatttcatccagaattatcagatgtagataactctcttatatacggaataacaggaggtgtgccacattatatcaataaactggatgtaaataaaaatgtggatgaagcattattagataatttatttctgcaaaaaatgtatagttgaaattttccacaagttacaatccacatcttctaaaaagcatttttcaaacacgttttaccattttaaaaacattctctgagggcgtctctttgcctgcggtaactcaaatttacaaaaaatttggtgtttttttctattatgaaagtgagaaaaaagtgctataatcccctatggcagaatatattctgtaataaaacggaataaaatagttatttttatggaagaatgtttcttagagaaaaggcgattttacaccttcatcgaaggggcatccgattgattgagcaagagattggagtgacagaaatgaatttgacagaaaaagaatttgtaaagtttttaagcaagtttgatgaacatccatttgatgtgaaaattggagatgaggtaagccatataggtaagggagagtcggaatttacagtaatttttcataagattccgtcgatgaaagaactattaacgagtacatcaattgcgcttggcgaagcttacatggatggaaagcttgaaatagaaggtgacctgtaccatgctttgaatatgtttttaggacagatgggtaagttttctacggataaaaaagcgttgaagaaattgattttttcttcacttacgaaaaagaaccagcagaaggaagtttcctctcattatgatataggaaatgatttctacaaaatgtggcttgatgaaacgatgagctattcctgtggatactttaagcatcctgaggacactttgtatcaggcacaggtacagaaggtagaaagaattctggaaaaattatatttgaaagaggggatgacactctgtgatataggctgcggatgggggtatttactgattgaagcggcgaaaaagtacggaattaaaggtgtaggaattactttaagtaaagaacaaaagaagaaatttgaggagcggattaaggaaaatcatctggaagatcagttggaagttcgtctgatggattacagagatttgccggaatctggatttaagtttgaccgagttgtcagtgtcggaatgcttgaacatgttggaagagataactatgaattgttcatgaagtctgtaaaaagtattatgaatccaggcggacttttcctgcttcattatataagtgcattgcaggaacatccgggagatgcctgggtaaagaaatatattttcccaggtggagttgtcccatcactacgtgagattatcaacattgcaggtgactatcaattctatacattggatgtggagagtcttagaagacattataataaaacattactctgttggaacgcaaacttccagaaacataaagatgaagtaagagaaatgtttggcgaaagattcgtccgtatgtgggaattatatctttgcgcttgcgccgccacattcatgaatggtatcattgatttgcatcaaatattatttacgaatggggtaaataacgatttgccgatgacaagatggtattaatttagctatatcagatgtgaaatgattcccatctcgcagcaagaatgccggggcattcttgattttgaattcgtagaattaattattaagactgctctgattaataaagtacgcagtctattttgtatatggaaagtcgcggttgattacgagaaattatccattcgaatcattgggtaaaagaatctgatgcaataatagataaaataataaacgtaagaaaatgaagagaggaattaaggaaatgaatattatattagcatctggttcgccaagaagaaaagaattactggcacaggctggatttgactttgaagtagaagtaagcaacgctgacgagaatgtggcagaggaatctccgacagaaatggtcgaggaacttgccgcaagaaaggcagaagctgtcgttaatcttcataataaaaaagaagacaactgccttgtaatcggtgctgatactattgtagtgcttgacgggaaaattcttggaaagccatccgacgaagcagatgctagagcgatgctcgcctctttatccggtcggacacatcaggtgtatacaggagtagcgttgttttcagtaaaagaaggtatcatagaaaaaaagacaaccttccacgaatgtaccgatgtgacaatggtttccatgacagaaaaagaaatcgcagattatgtagcatctggcgatccgatggataaagccggagcatatggtattcaaggtctggcagcgatatttatctccgaaataaagggagattactacaatgtcgtagggttgccaatcagcagagtataccatgaaattgaacaattctgatttgccgcaggaaaagagacgctcgcaggaaataaaatggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatggactgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaagaacacgaaaaatataactatccaatcctgttattatgtgaaataggagggatcgccaggtcatcctactacaaatggctccatcatgcagagacaccgaatgagagatttaacgaggaattggcagagaagctggaacgattccatgaaaaacatccagatatgggatatagaaggttaaatgacaagctgcggcacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcacactgtacagataacggagtaatggaaggcttttgggggatcttgaaacgggaaatgtattatgggaaaaaatttgagagcagagaagaattagagaaggcaatcacagaatatatagattactatacaaacgaccggccacagagaggacttggagtcttaacaccaatggaatttcatgaaaagcaacgattggcggcataaaaatgttgcccgatatacaccgggcaacacaaaaattttatatttttttaattgtctacttgacgggatgcacaccaaaagaacctatatttgtgactttagtcgctgcggtttgaatactcgcttatacacgctcgtatccaaaccttgctccgaggccacaaatataggttcttttatttcctgcgagctgtctttggctgctgaagtaaagtcagaatttatgttttaaaaaatttggggattctttagaagtttgtggcttgctgaggaatcaaacttgaaaggactgacattcaaactgttatcattgtgttacaataataaactaagtttcaaacacgctctaatacatatgcaaatcaatcttgttccactacagcatttctcatgctaatctcaataaaatatggctaaaattcagtgcttttcacatctattttcgtatcagtccactaaaatttaattgcctgatatttttatattttctgtcttcttccccaaatcttttgattgatttgccggattagaaataaacagccgctgtagatattctatcggattgctcaaaaaatatgaaaaagaagccctaaaaatttattgaattttgtgactttgtgctgcggaattttgaccatagaaacttcggactgctttttccgaagtttctgttttattgggcaaaatggagcgtttagcacaacggaacaaaatcaataaattttttagagcttcttcttaataatttttccggcaatccgattgctatgcttctgtagcggcgtctgtttgttttgctacgcaaataagaatttagttgacaaattgtaatatatgaattatagtggtactgaatgatactacttattgataaattatgactatttagaaattacaaacagaatgcgaggtctttatggataacgtagaattactcatgagctttggtcttaccagacaggaagccagagtgtatgttcttcttttaggggaaggtgcgttaagtggctatgaagcagcgaagcggcttggcatttcccgttctaatgcatatgcggcattggcggggctggtagataagggagcggcctatatggcagaagagcaggcagtacagtatcatgcagtttcgataaaggagttttgctcgaataagcttcattatatggaggaactttctgaaactctagagaggcagattccaaagcagaagcaggaagatgcgaagtatttgacgatacgtggcagaaggcacatcgaggataagttccgcaatatgcttaaggagacgaaggagagagtttatctttcggtatcggcatctgtgttagagttgttcagggaagaactgttaggattggttgcacagaagaaaaaagttgtcttgttgacagatgaagaatattctatggatggagcgattatttatcgtacgaagaagtttgaaaatttatctggaagtgcagactgtgagggagatgcggatggacagcttcgcctgatcacagattcaaattatgcacttacgggagaacttcaggataaggagacttcaacatgtctgtattccgctaatccgaatttggtaaggctgctaaaagatgctctggcgaatgaaatcaggcttattgagatagagaaaaaagatgcttcgatatagacggtgagagaaatatcatctgtaaagcagagttaacagaattagaagggcagataaaaaattagaagtccaaagtgaaatatcaagatattagaggaaaacttataaaagaaacgcaaaacggaatatcaagatattagaggaaaacttataaaagaaacgcaaaacggaatatcgagatattaaagaaaacttacaaaagaagccagaagcaaaatataaaagtaaacatctaaaaacaaagatataaatataagctataaaggaaggaaaaaaagatggaaaagaaaccatttgttacaaaagaacagttagataaaatcgtagaaaaatatcctacaccatttcatttatatgacgagaagggaatcagacagacagctcgtgatttatacaaggcattctcatggaatgaaggatttaaagaatatttcgcagtaaaagcaacacctactcctgcaattcttaagattttacaggaagagggatgtggaacagactgttcttctttaacagaattaatgatgagcgaccgttgtggatttgctgatggtaattccattatgttctcatctaatgaaacaccggcagaagaatttatccttgcaaagaagttaggagcaattattaacttagatgatattacacatattgatttcttaaaggatgcctgtggtattccggaaagaatctgctgccgttacaatccaggcggatatttctctcttggaacagacatcatggataacccaggagatgccaagtatggaatgacaaagccacagatttttgaggcattcaaacgacttaagagagaaggagtaaaagaatttggtattcattctttcttagcaagtaacacagtatctaacgaatactatcctgcattagcatccatcttatttaatcttgcagtagaattaaaagagaatcttggtgttcatatcggatttatcaacttatccggtggtgttggaatcccttacacaccagataaagagccaaatgatatttttgcaatcggtgaaggtgttcgtaaagcttacgaagagattttagttccagcaggaatgggagatgtaaagatctttacagaacttggacgtttcatgcttgcgccacacggacatcttgtagtaaaagcaattcatgagaaacatacttataaagaatacatcggtgtagatgcctgtgcagcaaaccttatgcgtcctgctatgtacggtgcttaccatcacatcacagttatgggtaaggaaaatgaaccatgtgaccacacatatgatgtagtaggttctctttgcgagaacaacgataagtttgcaatcgacagaaagcttccaaagattgatatgggagatttactagtacttcatgatacaggagcacatggattctcgatgggatataactacaatggtcgcttaaagagtgcggagattcttttacaggaagatggaagcacaagaatgatccgtcgtgcggagacaccagaggattactttgcaacaattgaaggctttgatttttagttttggctccatatacaagagataaatttgggagatgaatcagtaatttgctgttggcaaatttgatgaaacccagaagataaaacatccctatttgtgactttagtcgctgcaggttgaatgttcgcttaagcgctcgcattcatcctttgctcgaggtcacaaatagggatgttttatcttctgagtttctgtcttcggtcggggcggaattatgaattcatctccagccaaagaacagctctccctgagaaagcgtctctcccgcctgcggcaaattactactttcaccaacaatatctttggtgtataatttgttaatatatgtttacatttcacggatatacaacgaaaatagttgggaatcgttaagagaaaggatataacttatgggtgaaaagttatttactgcaaaggaagcagcggagatattaaaggtaagaaaaaacacagtatatgacatgattaagcgtggtgatttaaaggcttctaaacttggaaagcagcttagaatccgtcaggaggatctggatttttatattcagtatggaagtcaggcaaaggttgtagattcaatgcagacagggcataatagtaatattgataaagctgaatttgaaaaaaatacatctaagttaccgaatgtatcaaatgaaatatctggagtgagtagaacaaccagtgcaacgcaaaacagaatttcaaatcagattatcatctgcggtcaggatatgattcttgatctgttggcgaatcgcctgaatcaatgtgtagaggaaaatgtatttcgttcttataaaggaagctacaatggattgtatgcaatgtatcagggagaagtaaacgtagcaacagcgcatttatggcatggaaaaacgaacagttacaatattccgtatatcagcagtatgctgccgggaacggatgtaattgttcttcatttattaaaaagaaagcaaggtttttatgtaaagaaggggaacccaaagagaattcaatcttttgaagatttaaaaagagctgatgtaacaatcgtaaatagagaaccgggtagtggagtaagagttcttgtcgatgaaaaattacgtcaggcaggcattttcacacaggaagtaaatggatatcagaaggtagtaaattcacatcttgaagcagcagcgacagtaaacaggggagaagcagatgtggcagttggaagcgaaaagcacagcctgtctgtaccaggaatcgattttattttcatacaggaagaaagttacgatatggtaatccgaaaagaagatttcactaagaaatcttatcagaaaatgatagaaatcattcgttccccagaatatcaaaaagaggtagccggactcggcagctacaatgtagaaaacatgggaaaaattatttattctgactgtggttgcagaccctaacttttattctcagatgtcccattcaactactatactctaataaatccagagcaagcagcagctccccaactttcatccccaaatccctccaccattgctataataattcatccaaatctagcatattaaaaattattagtaacactaaaaaattgttagattttgctgcatatttattgacaaattctggtgcataaaatataatgtaataaaacgaaacaaaacaatataaaacgcaataaaacgaggggaaattatgagaaacatgaagtttgtgaagagaattggcgttgcagttttagcagcatgtatggttttatcctgtgtaggatgtagaagttcatctaacaaaggtgcagcagaaggaacaacagaggttgcagcagaaggtggacagactaagatttctgtagctgctgcagcaagtcttcaggctacatttgatgatgaactgattcctttatttgagaaagagaatccaggagtaaccgtagaaggaacttacgcaagttcaggagatttacagcagcagattgaatctggattagatgcagatgtattcttctccgcagcaacatctaacatggacacattagtagatgagaaccttgtagataaagatactgttgttgacttattaaagaacgatgttgtattaatcacgcctaaggattctaagttaggaattaagggtttcaaggacatcacaaaggcggatacaattgcaatcggtgatcctgaaagcgtaccagcaggtaaatacgcaaaagaaattcttacgaacttaggtgtttacgatgaagttgagaagaaagcaagtcttggagcaagcgtaacagaggtattaagctgggttgcagagggaagtgctgacgcaggtatcgtatacgcaacagatgcacagacagagaatacaaatggtgatgacaaagaagtagaaatcgtagcaacagcagaagattctatgatgcagacaccagtaatctacccggtaggtaccgtttcttcttctgcacataaagacgaagcaaaagcttttgaagatttccttcagacagatgaagcaaaagcaatcttagaaaaagcaggattcacaattaacgaataattaaaagacaggctggatgtatatgacaatggatttatcaccaattattatatctttaaagacagctaccctcagtattattattacattctttctgggggtggctgcggcccagtttgttttccgtcttaagagtaagacgatgaaaacaatattagatgggttatttaccctgccgctcgtgcttccgccaacagtggcaggattttttttactttatattttcgggatgagaaggccgatcggtaagtttttaattgaatattttgcagtaaaaatcgcattctcatggggagcaaccgtattagctgcggttgtgatctcatttccattaatgtaccgatcagcaagaggagcctttgagcaggtaaatcctgacgtgctttctgcaggaagaacacttggaatgagtgagtggaacattttctggaaagtgcagatgccgattgcatggccaggagttatttccggagcagttcttgcatttgccagaggacttggagagtttggagcaacagcaatgattgccggaaatatcagaggaaagacaagaacactgccattagctgtatattcggcagttgcatcaggaaaaatggatgacgcggggcagtatgtagtgattcttgtaggtatttcctttattgtagttgtatgtatgaattatttttctatggaaaagaaaggctagaattatggcattatccgttcacattaaaaagaaattaaaagattttgagcttgctgtagattttgatatggatgaaggtattgtcggatttttaggttcttctggctgtggaaaaagtatgaccttaaaatgtatcgcgggaattgagacacccgatgaaggaagaatcgtccttgatgatgaagtccttttcgataaaaagtcaggaattaatctttcgccacagaagcgtaaggtaggatacctttttcagaactatgcattatttccacatatgacagtaaagcaaaatatcgaggcaggacttgcagcatcaggcaagtcaaaacaggagaaaaaagaaatagtggaacgtctcttagaacagttccacataaaagaattggagaactcttacccagtccgtatttccggcggacagcagcaaagagccgcccttgcccgaatgatggcagcagagccaaagtttttattgttagatgagccattttctgcattagatgcttatttaaaagaaaaattaatgcaggaaatgatgacataccttaaccagtttaaaaaaggggttattatggtttcacacagtagagatgaagtgtaccagatgtgcagcgatacagttattatgcatcaggggatgatagaaacattaggaaaaacaaaagaaatatttgataatccgggaaccgtgaatgcagcgaggcttactggctgtaaaaatatttccagagccacaaaaactggaacacatgaggtatatgcatccgattgggatataaaacttactttcccggaacagacagagattccatcaaatcttacccatgtaggaatccgagcacacgaaattcatccgatagtctctaaagatacaaatttaaaagatatggattcaaatgaatctataaagttaaatacaatggactgccagttagaacgcatttctgaagcaccatttgagatgtatcttattttgcagaataaaagtggaaaaaatacgagtccgctatggtggaaagtcactaaaaaggagtggcaggaaattggggaaaaagttccagaaacggtggaattgccggcagaacatattattttgctgaaatagtaactgccgcaggcaggggcgagatgcctgttggaagatgaataattattctatgtgggtaaactttcctgactttgaatatccttagaataaatatttatctctaaatcatatatcctatatctgtggcattcaatccacaagtgacagaatcacagatataggcttttttctcaggcgtctgtttatccaataaattaaatcaatccaaaatgcttcaacgcattcctgattccatctctttcaatcggagtagtgacataggatgtattcgccagtacttcaggataagagtttcccattgcaatactattctttacatgtgtaagcatagacaagtcatttgtgctgtcaccgaatacataacaagaagctaaagattcacccaagtgttctacaatataatcaataccgccagctttagaacagccttttggaacaacttcttcaaaaccgtaaggatgcatttcttctcttgcgataaagtcgaaatgttcttttgtgcgttcgtggaacaagtcaaggctgctgttttcatcagttagaatgacaaatttatcgaaatctaaaacagggtcatcaaaaaagcggatgggctgttcaagatttgtttttgcataagagttacgaatggcggtaataggggcgaaaggtttttctgttttctgaaaataacaggacttgcggccctcatatacagcctgaattttacattcttctaaaatactttgcagactgtgcttcaaatcttcatcaagatcatagtgataaagagtcttaccgaggaaaataacttccgtaccgcagccacaaacatagccgtcaaaagggaattccttaatggcttctggcataaatccatatgtacgcccactgttgataaagatatagtgcccatttgcctgtgcctgctttaaagcctcaattgtactgtcaggaatatatccgggaatacctccggcaaggagtgtaccgtcaatgtcgaaaaacagtaattttctattcatagtgtaaaatgtcctttcgtagaaatattcatttacaatttgtaaaagattattaatggctaagttgatgtctttatttaaagaaagttctgtagtacaacggtttaatatagaagcaatctcaaacttcatatcaagttcccgtttatcttgtgcaagctgacctagtttctgatttttcgtctgcttctaaattcggtggtgacatcctcccccacctgtagaggtggtggcttcccaacctcggcaagtttggttctcgttcgatagcactactgtgctaagcatatgcgagctatccccgtgtgtcccacggttgtatttgttctctaaggtcatgcatttaccagacgcattccttcatttctgatatttatcgccgcatttacatctctgtcgtgatgagttccacactgcggacaatcccactctcttaacgcaagatttttcgttttaacattcttgtaaccacaaacagaacaggtctggctgcttgcaaaaaatctacccaccttcacaagtttcttaccctgttcctccagtttatatttcaaaaatgttgtgaacattccccagccgttatccaaaacggattttccaaatttcaacgaccgtgacattgctttcatatctaaatcttctatacatacgcaatcataagcattggttatctgtcttgactgcttatgcaggaagtcttttcgttgattggaaaccttttcgtgaagttttgctaccttaagcctctgcttattgcgattattcgaacctttctgcattttagaaagcttacgttgttctctcgctaattttttctccgcattcctgtaataccccggataggcaggctccttaccgttgctgtcacgatataattcatgcatggaaaaatctaaacctaaaaacttttgcagtttcttttcctgtacttggtcttcatactcaaaaaggatacttgcatagtatttttcgcttggggtctgacttactgttacagatttgagtctgtattcctctggaataatcctgtgctgttttaagcggacttggccaatcttaggtaatttcaaatatccattagatatggttatgttcccattaatgcagaccgtggaatagctgtttttattccgctttttcgatttgaaccttgggaaacctgttttcggctgtttgaaaaagttctgaaatgccgtatcaaggtgtctgagcgattgttgtaatgcgatactatctgcttcctttaaaaatccgtattcttccattttcttcattgcagccatttcttttgcacaaatagtatatgttatgtttgtcttgttctcctcatactgccggatctttctatcaagccaatgattatacaccattctgacacatccaaaagtcttagcaaacaaaatcttctgttcatcattgggatatattctgaatttatatgctctgtttgccaccatgccacttccttttcctcgaaaacccgcctgcgatacttgaacacaagcacaagatgatagtatagtaagaatactaaatgtgcgttattatctcaattttttattatccgactaaagatactatactataaccaggatgctctatcaagtaggtagcagacgcaattcatctcccaccttagaggttggagtcttcttgctgtaagaggataaaagagctgataataaacagtgtaattcgtcctttttgtaattaacatctcttagattccataaatttactgttattatataacatctttaaaatttatacaagagaaaaatgtaaagaatcgactatcatcaaaaaatatgttatgatattaaagtgtatcagatgtgagatgtctcccatctcgcagcaagaatgccggggcattcttgaattgaaaatagaaatatgagaaagaatggagcaaaagcctaaatattttgcttcatttttcaaaaaagaaaggatgaactataatggcaaacccaatcgttacaattacaatggaaaatggagatgtaatcaaagcagaattatatccacagattgcaccaaacacagtaaataactttatttccttagttaaaaaaggattctatgatggacttattttccatcgtgttatcaaaggcttcatgattcagggaggatgccctcttggaaatggaacagggaaccctggatacagcatcaaaggtgagttctccaacaacggattcacaaaccagttaaaacatgaagcaggagtactttctatggctcgttccatgatgccaaattctgcaggatcccagttttttatcatgcacaaagcagctccacatcttgacggtgagtacgcagcatttggtaaagtaattgaaggaatggatgtagtagataagatcgcatctgtaaaaactttcatggattctccatatgaaaaacaggtaatggcttctgtaactgtagatacacagggagaggaatatccagaaccagagaagattgagaaatagaattccatttcccggcccagccaaagcatagccaccgaagagagcctatcccttatatttgtggcttcggagcaaggtttggatgcgagcgcataaagcgagcattcaaaccgctgcgcctaaagtcacaaatataggggataggctctcttcggtggcatctattttgcctgcggcaaattcctatttcgttttcaactattttgtgttattatttggattgtcgttaaaagggcaggtgaaaaagattttttcttcaaaatgaggggaagaaaaaatgaaaggttggattgaattgagatgaataaattaaaaaagaaaaaggcaggaatcaaggatttctttaaggggaaacacggaagaaattttttgctggcattagatgtcctgttagcaattgccttttttgcacagccagatttgtattataatccacaagctccagatttttttgatcgcttttatgcagattccctaataatctgtggcgggttgtgggcggtacttgttttcctcacagtgaaaaaaattcatttttcggcagaggtaaacagaatactgacgtatatcgcaggaattgctactccatttatcgcttttttgtggttagaattttataatgatgcacagttttgggttccgattttcagcattccatttttatatctggtgctggatattattgtttattatgttatttatgtgctgtttttgctgatttttaatagcatacgcgcagcatcaatctgtatggttgttgtgacagccgtatttggaattttcaactatgaattgacattatttagaagtatgtcatttattgcatcagatatttattcctttgtgacggccgtttcggtggcaaatacctaccaggtgcagattgatgtggatacggctgaattttttatgatggcacttgtgcttgttgcgcttcttttaaagcttgataaggtgaagctgtttaaatggaagggaagaattgtgtacgcgatcgtatcatgcatgatatttgccggatttacacaggtgtatgtatatagcgattatctggaagatatcggtgttgatttccgtgtgtatcgaccgcagtataagtacagatattatggaacattgcttacgacgatgaggacttttggctatcttcatgtaacacagccagaagagtattctgttaatgcagtcaaaaaaattacaaagcagtatacagagaatgaatctacagaaacgcaggaaaaaaatacgtctacgcagaataaaacaacaaagaagccaaatgtcattgcaattatgaatgaatcttttgcagatttaaaagcagtaggagatttgcagacatccaaagactatatgccatttttccgtaaattaaaagaaaatgcgattaagggctacacatattcttccgtatttggtggaaatacggcaaactcagaatttgaatttatgacgggaaatacacttgcattcttgccggataattctgttccatatcagcttttcctgcgaagtaaaacagcgggtctgacttatactttaaaagaccagggatatagtccgtgttatgcattgcatccattttataagacaggttatggtagatataaagtatacccgctgatgggatttgataaattttatacatcggataatttttccgtatttacagatacggtgaattatcatatcacagactcagaagattataaaaagcttatcagcctttatgagaatcgtaccgacaaagataaaccattttatttattcaatgtaacaatgcagaatcatggaagttacgatggaagtacattggaaacgggagatgaagtgcagatagagggggatttacagtcttattcgaaagcagagcagtatctgaatatgataaaaatgtccgataaagcattaaaggaaattgttcactattttgaaaaagtagatgaaccgaccgtcattgtatttttcggagatcatcagccagatttagaagagacattttacaaccgtctgcttcatacagatattcagaaattagagggagaggacttagagcagctctacaaagtaccatttttaatctgggcaaactatgatataaaagaggaaaatgtagaaaaaaccagtaacaattatctgtctacctatcttgcagaagttgcaggaattaaaaagacaggttatcttgaatatttaacaaaactcagagaagaaattcctgcaatcaatgcgattggatattgggataaaaatggtaaattttacgagattgatgataaaaaatctccgtattatgatttgatacatgagtataatttgctcgaatacaataatctttttggaaaagacaatcagcagaaagaattcttttacctgaaagagtagaaaaaattgtactttgcagagcgaaacgtacgcctgcaaagagagcctttcccctatatttgtcctttatgaataaataaaagaataatttttggcagttaggaacgatacatattatatatgatggtgttatactgtgacaatcaagagaaacagtagatatttataaatggatcttttagatgtttctaattgttttcaaattcagctgccgcttacgttgacaaagtatgcacaataaaaagacggatacagaaagttatattatttctgtatccgttttattattattatttatatttaaatcagataatgaagattttgaaaaatatatgcgataccgcataaagtatccgttccagaagaatgaccaatagaggaaaagtcagtgagaatctttttggaatcaggcaggttactgagggaacagaccgccatgctgaatcacatatatctggaacaatttgttcaagatctgctgctggagcaaggggataatcaaaggaaataatttcataacctgcctgagtaataacggaaatatgtttttctggtaagtcttttctgaaaccgtaaagaagacctccgccatggaaataaaatatttttgcttttgttgtaacggtagtttctttgtatattgttgcctgttttatccaggcggcattgtctaataccttatcatatgattttaacattggaaaccttcttaaaatgtagatgtagatgttatggttggtatgttagcagcaaataaactgggtgaattagacagagatgtatataatgaaaagaaaacaattgcatactaattgttattaatttttgttattaattcaaaataagatagacaaaaatagaaccccgaaagtcacaggtatagcggatgtgtctttcggggtttttaaattttctttaataaaattgtagatttaggacactatttcttttttcgtctatacgaaatctacaaattagtagttattccacaatctctacgttaatattatgtctctttaagttctctaatgcatcttctggaatctccgcatcggtacataccgtatcaatctcagaaaaagtagtctgaattacaacccccttctggctgaacttactggagtcagcaagaatgatcatacgatttgcggagtcttccatatacttcatagtttccacacgcatcaggtcatcacaagtaaaacctgcatctggaataaatccatctgtgcctacaaagaacttatctacatagaattccttcgcacatttgcgaactaatggtcccaccataccctgatattccttttgatattcgccaccaagaaggataactttacgaatcggaagctcgcgtatacgaatcgctatgtaagcagagtttgttatgatggtgacatctttttttaactttgcaagctgttctgcaagtaaagcacaagtagagccagattcaagcataactgtttcgccattagaaaccatctcagcagcctttgtggcgatttcaagcttcttatcataatttattgttaaacgtgtgttaatatcattggcattcttaattaaagcgtagccatgctctcttgataaaagtccctcttcttcaagatggtcaaggtctttacggatggttacctgagacacatctaaaagttcagctaaacgactcacttcgattttttgataaagatttaccaatttaatgagtttggactgacgttctgtcatttgaaacacctctttctttctaaaaaaagtataacatattgtttggcaaaatatcaaggaaggaataggaaaaaaagaaataaattatagagaaattgttataaaaatatcgttcttaaatgggaatttgccgggccgtctctctgcctgcggcaaattcctatttaacttcaatctggattgtgatccgctactgtggtaaaatatcgtttggaaatactttttatttataatttgacagcaaacaactccagatagtatcattttttataagacattttaataaggtaaaaactaattacaaatacgttatgaaagaggtattaattatggagttgatcaaagcgttaccagagatttttgaagattttgcggagcagagaaagaagtcctttctgacgatgaaggaattgaaggatagggatgttccggttgttggagcttactgtacatattttccacaggaaatcgcaatggcgatgggagcagttacagtaggtctttgttctacttcagacgagacaataccagtggcagagaaggatttgccaagaaatctgtgccctatggtaaaggcaagttatggttttgcagtatcggataaatgtccgttcttttatttttccgacgtagtagttggagagacaacctgtgatgggaagaaaaagatgtatgaactgatgggagagtttaaaaatgtttatgttatggagcttccaaacagtcagagtgaaactgcattaaagctttggaaagaagagattcttaagttcaaatcttatctggagcagactttcaaagtggagattacagaggagaacgttcgtaaggcagttcatatgatgaatgaaaatagaattgcgcttaaaaatctttatgaagttatgaaaaatgatccggcaccgatgaatggacaggaattgtttaatgtattatatggaagccagttccgttttgacaaagaaaaggttccggaagaaattcatgcgcttcgtgaaaagattatgaaggagtatggggagggcgagaaacagccgaaaaagaagagaattcttttaacaggatgtccaagcagcggtgcgccaatgaaagttgtgaaagcattggaagaaaatggagcggttgttgttgcctatgaaaactgtggcggtacaaagtcggctgaccgtttaatagatgaatctgcagaggatatttatgaggcgatcgcggaaagatatcttcagattggctgttctgttatgacaccaaataagaatcgttatgaacttcttggaagattaatagaggaatataaagtagatggtgttgtggaaatgacactgcaggcctgccatacttacaatgtggaggcaaagagtattgaaaagtttgtaaaaggaaaaggtgttccgtatattcatgtggagaccgactattcacaggaggatatcggacagcttaacacgagaatgacagcattcgtcgagatgttgtaagaggaggaaaagacacctatggcatttacacatttacatgtgcatacggagtacagtctgctggatggttctagtaagattaaagaacttctgccgagggcaaaagagcttggaatggatagtctggccatcacagaccacggggttatgtatggcgtgattgacttttataaaaaggcaaaagaagtaggaattaaaccaattcttggctgtgagatttatgttgcaccagggtcaaggtttgacagggagcagggacgaggagaggatagatattatcatcttgtactgcttgcggaaaataatcagggctataaaaacctgatgaagattgtgacaagagggtttacagaaggatattattacaaaccaagggtagactatgaagtgcttgaaaaatatcatgagggaattatcgcacttagtgcctgtcttgccggagagattccgaataagattttaaaagaggattttgatggagcaagagctgccgcaaacaaaatgcgtgatatttttggagagaataactttttcttagagttgcaagatcatggaattcgtcagcagacccaggtaaataccagcctgattcgtctttccagggaacttgggattccgatggttgtcacaaatgatgtgcattatatcagagaggaagatgcggttccacatgacctgcttctttgtatacagactggaaaaaaagtttcagaccaggatagaatgcgctatgaaggcgggcagtattatctgaagtcggaagaagagatgcagaaggtatttccctatgcgagagaggcgatggataatacccataaaattgccgagcgatgtaatgtggagattgtttttggtgagcagaaagtgccaaagtttgatgtgccggaaggttacgatgcattttcttacttaaaagagctttgtgagactggtcttgtgaaaagatacggggacccgccgccacaggaattgcaggaaagactttcttatgagcttagcactattaaaaatatgggctatgttgattattttctcattgtgtgggattttatccgttttgcaaagagtcagggaatcgctgttggcccgggacgaggaagtgcggcaggaagtattgtttcctattgtcttgagattacgaatatcgacccaatcagatatcagcttatttttgagcgtttcttaaatccagagcgtgtatccatgccagatattgatattgacttctgttatgagagacggcaggaagttattgattatgtttatgaaaaatacggcaaagataaggtagtgcagattgtaactttcggtacgatggcggcgcgtatggcagttcgtgatgttggacgtgtccttgatatcccttatgtacaggttgataatgttgcaaaaatgattccaatggagcttggtatcacgattgaaaaggcattaaaatcaaatccggaattaaagcaggcatatgagagtgatgatgttgtaaagaatcttattgatatgtcgatgcgtctggagggattaccgagacatacatcaattcatgccgctggtgtcgtaattggttcaaaaccgctggatgaatttgtcccactttcaagaggtgcagataatgtcatcacaacacagtttacgatgacaaccatcgaagaattgggacttctgaaaatggactttttaggtcttcgtacactgaccgtaattcaggatgccgcacgaatgattggaaagaaacttggccatgattttagtattgatacaattgattatgatgatgccaaagtatatgagatgattgggcagggaaagacggagggtgtgttccagttagaaagtgctggaatgaagtctttcatgaaggaattaaagccaacgaatcttgaggatgttattgccggaatttctctgtaccgtccgggaccaatggattttattccaaagtatatcaagggaaagcaaaatcaggattcaattcagtatacctgtccggaactggaagaaatactggcaccgacttacggatgtatcgtttatcaggaacaggttatgcagattgtaatgcgtcttgccggttacacacttggccgaagtgacttagtgcgtcgtgcgatgtccaagaaaaagggagatgtcatggcgagggagcgtcagaacttcgtttatggtaatgaagaagaaggtgtagaaggctgtatcaaacggggaattccagaagaaaccgccaataagattttcgatgaaatgattgattttgccaagtatgcatttaataaatctcatgcggctgcctatgcggttgtttcgtatcagacagcatggctgcgctgctattatccggtagaatttatggctgcgcttcttacttcagtaattactaacccgaaaaagattacagagtatatcaatacctgccgtgtgatgggaatttccatcctgccgccggacatcaatgagggggaagtcggattctctgttgcaggtgattctattcgatatggacttgcagcgattaagagtctcggaaaaagtgtgattgatgtaatgacacaggaaagagaagcaaacggaaagtacaaagatttaaaagattttatggggcgtctcacatcgaaagaaatcaataagagaacgatagaaaaccttatcaaatccggagcattggacagttttggtaagacgagaaaacagcagatgcttgtctatccggttgtacttgaacaagtaaaccgggagaaaaaagagtctatgagtggtcagatgtcattgtttgatttcttttccgaagaagagaaaaaagaatatgagatgcagtatcctgatgttggggagtatgacgatgcgcagaaacttgcacttgaaaaagatgtgcttggtatttatgtcagcggtcatccactggaaaaatatatggattccattgagaagcagacaactgccagatcgacagatttcgaaccggatgaggaaagcggacgtgcaatcgtaagagacgggcagcattatgttgtcggtggtcttattagtaatatcacagccaaacttacaaaaaataatcagaatatggcatttgttacgttggaagacttgtatggtactgtagaaatcattgtattcccgacgatatatcaaaatgtaaagccgtatctcatcgaagataatggactttatgtgaaaggccgggcatccgtttctgaagaaagtggtaaactgattgcagaatatattgtgccgattgaccagattccaaaggaagtatggattcagacagagaacattggagaatttacagataaacaacaggatttgtataaaattatcagaaaatatcccggcaaagatgaaattgttattttttccaaaaaagaaaaagcaataaaaagacttccaacatacgaaaatatttctgcgaaaaatgacgtatttagcgagttaaaatcactttttggtgaaaaaaatgtaaaggttcgcgagaagagtattgaaaaatcccaaaaaaagagataatatatgtaatcgttagggagtatacttagggaattatgaaatggaggtaacgttagatgaataagactagcgcagttcagacaattggaattttaacaagtggtggagatgctccaggcatgaatgctgcattaagagcagtagcaagaacagcatgggcaagaggtattgatgtaaaaggaatttatcgtggttacagcggactgttaaacgatgagatctttgatatggagaaggaattcacatgtgacatcatttctcgtggtggtacagctttatttaccgcaagatgtgaagaatttaaacagttagagtatcaggaaaaggcagcagagattttaagaagtcataacatcgacggacttgttgttatcggtggtgacggatcttttcgtggagcacagaagttatctgcacagggaattaacacagtagctcttcctggaacaattgacttagatattgcatgtacagaatatacaatcggttttgatactgcagtaaatacagctatgcaggcaattgataagattcgtgactcatccacatctcatgaaagatgttctatcatcgaggtaatgggaagaaatgctggttatatcgcattatggtgtggtattgcttcaggagctgaggatatcttaattccagagcgtttcgatggtaacagaccaaaacttgaaaatgaattaattgaaagcattcttgagaaaaaagcacttggtaagaaacatcaccttatcatcaacgcagaaggtgttggacattcttatggaatggctaagagaatcgaacaggcaactggtgtagagacaagagcaagtatcttaggtcatatgcagagaggtggaaacccaacagcaaaagacagagtatatgcttcttacatgggagctttagcagtagacctgctttgcagcggcgctacaaacagagtagtaggataccgtaatggtcagtatattgactacgatatcgaagacgcactcggaatggctaaagacgtagaccagtatgagtttgaaatcgctcagattttaggacgataatataaagccgagtagaacttggtagacagacgaagaaccccgtatatccaagaaggaattttattctgttgcgttaaatcttggatatacggggttcttctgcttgttggcaagctttaaactggctttatgtgggccgtcgggtaaaaaaattgaaagatttgtggaggcgaagggggattcagtcttatggcttttgcttattcaaccacgatagattctcgataaatcttctcgatatcctcccttgttaattcaaaaggacatgtagctaatttcgaagtattctccatcatcctgtcgatgtagaatgtgacttctttttgtgttaagctgactgtgccaaggatttcagttaagtaagaggcgaagtcatcgagggttttgaaacctaagagggtaaggatttcttcgacatcttctggtttctgttctgcgtaaacgcggaggtaagcagcaaggaagattccgcaggcttttccgtgtgctactccattatggtaagttacatcataacttaatgcatgtggaatggaagttccggtctgggcgattgccattcctgcgattgtagaagtcagcatgagtttttctgcgagttcttcgcttaattcttcatcggaacgaaggaatggaacgatgtctccccacagtttcaatgcgtagtttgcgaacatctggttatagatgtttgtctggatgcttacgcggctttcggctgcgtgtgcaagggcatcgatgcaagtgttgattaaaagatttttacttgcggacagtaaatatttaccgtcaatgagggcgatgtctgggaaaatcttgtaggaaatacttttctttgtctgtgtgtcgtgacgggtcagaacggagacaggagtaacttctgaaccagtaccgcaggttgttggaacggcagcgattggaagtgtttttaagtcttttgctacatagaagcagtctccggtttcttctgggttggcaattaataaagcgattgctttcgatgcatctaatggagaacctccgccgatgccgataacgaagtccgctttgaattccttaccgatttcagcggctcttacgactgtctcaacagatggattttcttcgatttcattgaaaatctgataaggaacggaagcttcctctaaaacagcgataacatcgtcaagcgaaccattttttttggaagaactatgtccagtgataacgaatgctcgtgttcctaaagcaagaagttcttttttgtgattctttacacagtttttttctgcataagtatttgtagggtcaaaaaaatgcatgataaactcctttcatggttagactaatcgcaaatgcgattttaacggtgaaatagtatactgcatcattgtcatttggctggaaatcaataaaacagtacactggttattttctgctatagtgtagcatagcagaaagaaaaattgcaaattgcaaagcttttttttcgcttttttcaagggttttctgattttcggcttgcagtatcccacgtttatgttaagatatactgtgagactttatctcatcatataaaaaacaaaatatcggagtatagtaatattggagttagaaatatacagatgatatttttagaaattaaggaggtaccgatgaagaagatactagcaccgtctattttgtctgctgattttgcaaatctgggcagagatgttttgactgcgattgatgccggagcagagtatgtgcatattgatgttatggatggaatgttcgttccacagatttcttttggaaatcctgtaattaaggcacttcgtccgctcacagatgtgatttttgatgcacatttaatgatagaagacccaggtagatatatcgaagattttgcaaaggcaggagcagatattattacagtacatgcagaagcctgcacacatcttgaccgagtagtacatcagattaaggattgcggtaagaaggcagccgttgcgattaatcctgcgacaccactttctgcgattgagtatgttttaccagaattggatatggtattagttatgactgtaaatccaggttttggaggacagaagtacattccttactgtggcgagaaggttcgggagcttcgtaagatgatcacagagaagaatcttgatgtggatattcaggttgacggtggagtgaaggccttgaatatagcagagattgcagaatgtggggctaatatatttgtatgtggttctgctgtatttgaagggaatattgagaaaaatgttaaagagattttagagcagatgaataaataatttgagataataacgcacatttagtatacttactatactatcatcttgcccttgtgttcaagtatcgcaggtgggttttcgaggaaaaggaagtggcatggtggcaaacagagcatataaattcagaatatatccttgaatttgaataaccagtcacattaaatttgttctgaagttaaaaagttacaaataattaaggggtaatttcagtgaaaactgagcaaataatttctaaagaaattgataaaattttaatagaaattttataaaaaatttagttaaacgagaggtaaatattatgagcgattgtacacatgattgtagcagttgtggcgaaagctgcgcacagagagagtccaaaccagaagattttcttgtaaagttaagtaaaggaagttctgttaagaaggttattggtgttgtatccggtaaaggtggagtaggtaagtctatggtaacttcacttcttgcagcagcttctatgagagaaggatttaagacagctattttagatggagatatcacaggaccatctattccaaaggcatttggtctttccatgaatcttgtaggtaacgcagaaggactgattctgccagcaacaacaacttgcggaatcgacattgtttctgttaacctgatgcttgcgaatgagacagatcctgttatctggagagggcctgttcttggcggagtaatcaaacagttctggggagagacattatggcagaacattgactatatgttcattgatatgcctccaggaactggtgatgtaccgctgactattttccagtctgttccgttagatggtattgttatcgtatcttctccacaggaattagttggaatgatcgtagaaaaagcggtgaacatggcaagaatgatgaatgttccaattcttggtttagtagagaatatgagttatgtagagtgtcctgactgtggaaagcagattaaggtatttggagaaagccacattgatgagatcgcggcagagtatgatgtacctgttctggctaagcttccaatggacccagcacttgccgcagcctgtgatgcaggaaagattgagtacgttgaaaataattatatgaaagatgccattgaggtattgaagaaattataatatgaaacgtcatggaggcgtaaatggacaaaaaaaataatcagaatgataatccaaacaaaaagaagaatataaagtctgccattattcttctggtcgtttgtcttggaattaccgctctctttacttctgtgatgagccgttataagaatggttcacagaagaagatttcgtatagtaagtttcttacgatgttggataaaggagagattaaaaaggtacaggtagcagaccgaaagatttatatcgaaccgaagacacagcagaatccgttaatgaaaacaacatattatacggtttctatgaatgatgcactgctggttaaccgtttaaaagaagcggaggacaataataagattagttcttatgaacagcaggacagcagtggatcgaatgcgattctttctgttatggttagttatgtacttccgtttgtgctgatctatgcaatgatgtattttgttatgcgtggaatcggcaagggcggcggtatgatgggaagtgtaggaaagagtaatgcaaaggtatatgttgagaaaaagacaggagttacttttgcagatgtagccggtcaggatgaggcaaaggaaagtcttactgagatggttgatttccttcataaccctggtaaatatattgaaattggtgccagacttccaaagggtgcgctgttagtaggccctccgggaactggtaaaactttacttgcaaaagcagttgcgggtgaggcaaatgtaccgtttttctctctgagtggttccgactttgtagaaatgtttgtcggggtcggtgcatcaagagttcgtgatctgtttaagcaggcacagtctatggcaccttgtatcattttcattgatgagattgatgctatcggtaagagccgtgacagccgttatggtggtggaaatgacgagcgtgagcagacattgaatgccctgcttgcagagatggatggattcgattcttcgaaaggccttgttattttagcagcgacaaaccgtccggaagtattagataaggcacttctcagaccgggccgttttgacagacgagttatcgtagaacgccctgacttaaagggccgtgtggagacattaaaagtacatgcaaagaatgtcaagatggacgagacagttaattttgacgaaattgccctggcaacttccggtgccgtaggttctgatcttgcaaatatgattaacgaggccgcccttgcagcagttaaagctggaagagaagcagtatctcagaaagacctgttagaggcagtagaagttgttattgccggaaaagaaaagaaagaccgtattcttggtgaggaagaaaagaaagtcgtttcttatcacgaagttggtcatgccatggcaattgctgtgcagaagaatacagaaccagtacagaagattacgattgttccaagaacaatgggtgcactgggttacaccatgcaggttcctgaagaagaaaaatatctgatgagtaaagagcagatgctcagcgaattagttacactttttggtggacgtgcggccgaggaagttgtatttaattctgttacaacaggagcttctaatgatatcgagcgtgcgacccagattgcaagagcgatggtaacacagtacggtatgtctgaaagatttggacttatgggactggagtctgtacagaaccgttatcttgatggacgtgcagtgatgaactgttccgatgcaacaggtgcactcatcgatgaagaagtaaaagaaatgctcaaagtggcttacgataaggcgaaaaagattattgaagaccacagagaagttatggacgagattgcagaattcctgattgaaaaagagacaattaccggtaaagaattcatggaaatttacaataaatctttaaagaaagatgaactggaaagtgttgaagcgaatgttgaagaggataaggagaaaacagaattatccgaggcagaaacggtatcagaagaatcttcattaaaagatgcggaaagtcaggatgcacagaaagttaccgaaaagaaagacagtgagcaaacaaaacaggaagagtaaattatgtttgatattcaggaagaactgaaaaaactcccggcaaagccgggggtatatctgatgcataatgcacaggatgagattatctatgtcggtaaggcaagaatccttaagaaccgtgtgcgtcagtattttcagagtagttataataagagtgtaaaaatccagcacatggtttctcacatcgcttattttgaatatatcatcacagactcggagcttgaggctctggttttggaatgtaatctgattaaagaacaccgtccacattacaatacgatgctgaaagatgacaagagttatccatatattcgtgtcacagtgcaggaagattatccgagaattttattttgccgtcaggtgaaaagggataaatcgaaatatttcggtccgtatacgagtgcgggggcggtgaaggatacaattgaactaatgagaaaagtatacaaaatacggagttgtagccggtcattgcctaaagagatagggaaggaccggccctgtctttattatcagataaatcagtgtgatgcaccgtgtcagaattatatttctaaagaagagtaccgcgcccatgtggataaggcgttgaagtttttaaatggcgatgagaaagaaatcataaacagtctggaagaaaaaatgaaaaaagcggccgcagaacttgagtttgagcaggctgccgagtatcgtgatttaattgaaaatgtaaaacgaatcggtgagaagcagaaaatcaatgatactggtggagatgacagggatattattgctatggcaaaggccggcgatgaggcagttgtggctattttctttatccgaagcggcaagcttctcggcagagatcattttcatatgacaggaatcggagacagtgaaaagcaagagattatcacggactttattaagcagttctatgtagggactccatttattccaaaagaaattttaacgcaggaagaagttcttgatcaggaaattcttgaaaaatggctttcagataagcgtggaagtaaagtgatttttgctatgccgaagcgtggaagtaaacatcagatgatggagcttgcaagaaagaatgcacagaatgttctcgcacaggacagtgagaaattaaagagagaagaacgcagaacaattggtgcggtacatgaattagagcaggcattaggaattgggaacttaaaccgtatggaggcatttgacatttccaatacaaatggatatgaaaatgttgcttcaatggttgtttttgaaaaaggtaaggctaaacgaagcgattatcgtaaatttaagataaaaaccgtagccggaccggatgattaccattgtatggaagaggcgttagagagaagattttcccacggtatcagggagcagaaggagcgggaagaaaagggacaggatatggaacttggaagttttacccgttttccggatattcttatgatggatggaggaaaaggccaggtaaacattgcattacaggttctcgaaaagctgggattaactattccggtctgcggtatggtaaaagatgatttccatcgtacaagagccttatattataacaatgaaatcattgaatttcctaaaaattcggaagcatttcggatgataacccgtctgcaggatgaggcgcatcgttttgcaatcacatatcataaagcactccgtggaaaagagcaggtacattcggtacttgatgatattaaaggtatcggtcccgcacgaagaaaaagcctgatgaagcattttaaggatatcggaaaagtaaaagaagcttccgtgacagaactttgtgaagcagatggaattacagaaaatgtagctgaagaaatttaccgcttttttcatgaggatacttctaaaaaaaatggggatgtggtatgataaatatatcagatgtgagatgattcccacctcgcagcaagaatgccggggcattcttgaatggtgtggatactggtataatactaacgtagctctgcaaaattatacacagggagaatagtactgctgctgagtgattcaatacaaaccaaagaatatgggttttacgatgaagaagagtaaagaagtaattttggctggcagatactgtgggtgaatcttactgtgtagtttgcaagagaaataaacttaatgaaaaatggatatgtactctcggagtctttcttgcacttgcttttgtggctgattttccgccagtcgtacccgaatttcatcaacatacgcaccgcgtacgcctcaaaaatttggacacaactgacaaaaaatcttctcacaaaatcaagcacaaaaagattccgagagtacatcggataattacggagggaattatgtacaaggtaaaacttacagaatttgtaaacaagatgaatttaaaaagcctgttaccagatattgatacagacagcattatgattgagcagtctgcggtaaaccgtcttgcattgcagcttgccggattttttgaacattttgattcagaaagaattcaggtaatcggtaatgttgaggcagcatatatgaagcagcttgcaccggaatctatcccgcctctttgtgagaagattttcagctttaatattccatgccttgtattttgccgtggattagagccgtcacaagagatgcttgatacagcagaaaagaacggtgttccaatctttacaacagagatgacaacttcagattttattgcgaactctgtacgctggctgagcgaggaacttgctccacgtatttccattcatggtgttttggttgacgtatacggcgaaggtgttttgattatgggtgagagtggaatcggaaagagtgaggcggctcttgaactgattcaccgtggacaccgtcttgtatccgatgatgttgttgaaatacgtaaaatcagtgacgacacccttctgggaacatctccagatattacaagacattttatcgaacttcgtggtatcggtattgttgatgtaaagacattgttcggtgtggaaagtgtaatgtataaccagacaattgacatggttatccgtttagaagactggaacagagaagcaaactacgacagacttggccttgatgaagaatatattgagttcctcggcaataaggttgtctgctactctattccaattcgtccgggtcgtaaccttgcggttatcgtagagtccgcagcgattaactatcgtgcgaaaaaaatgggatataatgcagcacaggaactttataaccgtgtaacgggaagtctttctacgaataaagaagaacagaaagaacagtaattaagatttgcaaaagagctaaagtgtgtttggaaaatctgaaagcaatctaatcctctgatttatggtatatcagatgtgagatgactcccatatcgcagcaagaatgccggggtaatcttgaatttgcagaaagtatttttcggatacatgctgattatgaacaggtaattttttgtttaggaatttttaacaagaatcatatatgaaacttttttgcacaacaaatgttctgggagataacaaaaatattagctttttttggcactttatctaaagggagcgagaaagctcccttttattttgtgttttttccacattgtacttccccacgttttagagtatcatatagtatgtatctaaatataggatgcaactatatagttgttttaagtgttttagataggagatatataggagatattatgaataaggaattccttcagaatttgagagagcagattaaagcaggaacagtaacagagcaggaaccgatgaataagcacacaagttttgccattggaggcccggcagatgtttttgttcagccggcaacaagggaagaaatcagaagtgcggtttattgtgcaaaagaagcggggattcctttttttgttatgggtaatggaagtaacctgctggtatcggacgaaggttttcgaggaatgattatccagataggtaagaacttccaggcaatttctgtgaaggatacagtaattgaagtgcaggcgggtgctttgcttagcagaacagccagagctgcatggaatgccggactcaccggttttgagtttgcggcaggaatccctggctccgtaggtggagcagttgccatgaatgcaggagcatatggcggtgaagtgaaagatgtccttcttgatgcggaagtattgacgcaggagggagaatttcttacattaacgggagaggaattagatttgtcttaccgtcatagctgtatttttgagaaaaactacgttgttttgtctgcgcgtttttcatttgaaaaaggtgagtctgataagattaaggcacgaatggatgagctggccaaagccagaagagagaaacagcctttagagtttccaagtgcgggaagtacttttaagagaccggaaggttatttcgcaggaaagttaattcaggatgccggattaaaaggctataccgtaggcggtgcacaggtatccgagaagcatagcggatttgtggttaaccgtggcggggcgacagcagaagaggtagcttttttaataaaacaggtacagaaaaaagtaatgaaacagtttaatgttatgatgcagccggaagtccgctttgtcggatttgcggatacagaggtgagagagtgagatttgtaatagtttccggcatgtctggtgcaggaaagagtaccgcattaaaggttcttgaggactttggtttcttttgtgtggacaatctgccagttgcattgcttccgaatttcggagagattgcttctgacagacagactgaagtagacaaagtggcggtaggagttgatatccgtaacggagaacagctcaccagattaaacagtcagttagaagtcttgtgtgaacttggaatagaatatgagattctgtttttagatgcagaagatgagactcttgtcaagcgatataaagagacaagaagaacccatccgctcgcaaaggaggaccgcatagaaacggggatttccagagagcgtgagatgatttcttttatccgggacagggcagattatattattgatacaacgactcttcttaccagagaattacgacaggaagtggagaaaatttttgtcgggaatgaggaatatggtaattttattatcacagtactctccttcggattcaaatatggaatcccttcagatgctgatttggtatttgatgtgcgttttcttccgaatccttattatgagcaggcattgcgtccgctcacaggtaatgaccgttccattcaggaatatgtcatgaagaatggagacggccgaaagtttcttgataaactggaagatttaatgcagtttcttatcccacgttatttagacgagggaaagaacagccttgttattggcatcggctgtaccggtggcaagcatcgttctgttacgataacgaacgggctttatgcaaggctgaaaaagtttccgtataccgttcgtatggaacaccgggatattgagaaagacgcccggacaaaaggaaagtaatcgagtaattgatgtaaggagatagaatatgtcattttcttctgaagtaaaagaagaactttctcatgtggacggtcacgaaaatcactgcatgattgcggaacttgccgcaattattggactttgtggaaaaatcaaatgtgaagatggaagatattctctcattcttcacacggaaaatgtatcagtagccagaagattttattctctgattaaagacgtttttcattttcagccgcaagtttctacaacacagcatgaatttttaaaaaagaatcgcttttatatgatttccatagaggaatctggacagacgttaaagattttaaagacagcacagcttataaataatcttggacagatggacgaagaattttctgtgaaagataatccggtattgcagcgtacctgctgccgcagagcatttttgcgcggagcatttctttctgccggttctatcacagacccggagaagaattatcattttgaaattgcctgcatatcaagtgagaaagcagcgcagataaaagaattgtttgaattttttggattagaggcgaagattgtactgcgaaagaaatattatgtagtttacttaaaagaaggtgctatgatttcggacacattgaatataatggaagcacatattgctctcatgaagtttgagaatgtacgcattttaaaagatgtgcgtaactcagtaaacaggagagtaaactgcgaagcagcgaacataaataagaccgtatctgcagcgagaaaacaaattgaagatattgaatatataaaaaatacagttggtttagagcgattatccgagaaccttcgggacattgcctatgccaggttagaggaaccggatgcaacattaaaggaacttggcgaaaaacttagttctccagtaggaaagtccggtgtgaatcacagattaagaaaactgagtcaaattgctcaggatattagagaaaaagggcatctgtaatattttttcagtatttgctttggcaaagctgaaaatactaagataaatttatttcatttatagcaaaataggaggttaacatgatttcaaaagagatggagattaaaatcccttcaggattagacccaagcaccattgcgttattcattcagattgcaagccagtatgacagcagtgtatatgtggaggtgaaaaacaaaaaggtgaatgccaagagcattatgggaatgatgactttaggtgttccagcaggtggaaagattaatgtaattgcaaaaggcgatgatgaaacaaaagcaattgaacatataggtaagtatttgaataatgatttggctcattagaagagacgaatccttgtaaagaaatatccccagatgtgactttagtcgcggtggtttgaatgctcgcatccaaatcttgctccgaagccacatctggggatatttctttgcaaggattctgactttgccagaccgaaaagagaaaatcatttttgtcgggagatttgagattttaagtggaaggtaaagaattcgaaacaaacagaacccccgaagcctggcatatgtaaaaatgcgccttagagcaaactcttaatgcggttgagcattaagagtgcagtgatagagtgcatttttacatatgccaggcttcggggttcgtctgtttagccaccaacctcactattgcagaggccgcaggccgtaatacccgtagattagcctttcatcaaatgaaatcagagcccattttccatccttaattccgaatacgatttttcccgtagtttttctcgttgggccgtttttctttgtttctttgtaccagtttttcaagttctcagatatgtcaattttttcgatggatgtctggctgcttcctcctaagagggaggagatagagttctttatggaagtccataaagaggagtttccatcggtaatctgggatttgatttcatcatagatggttcctggcaggctgtagaagtcgatattttttgtagtgacggttacagtgcaggagttataggttgcggagacatcggtaattttgtaagatgcctgatcgaccatctcatcacatagagtagttacgtcaatactgtcaacatctacgagtgagccgagttcgctatcaccgatgtatgtttttaattgttgttttacgagttctcttacgtttggttcggacttcagtggttccggtaaatcggaaggagccacgtcggagaagtccatatttttggcgtaagtgaaaatctgcctggttgcttcccggcaaccttgttttacgcgggaaatgtaataaaagtatcctccgattccgcctgcgataaggcagcagataagaatagctgcaacgatcggtacaaagctttttctcttaggggcaggttgatttatgtcattacctgatgatacctgattgtaaactgcattgcttaaaggggtgtgacattttttacatatcttttcgttctcatcataatatgtgccacagtttggacaattcatgagcagtcctcctttttataataaaattttgaatcgttcagaaacatgcaaatttagttgatttttgttttgattagttattatagaaattattttttcttctttttttataaaataatctgaaaaacatagttagtatgccttcttttatatttaaaagtataggggctttttttgtgtgtgtcaagataagaggtttttcgatttttccctgtatggatagacaaaaattgccgaaaaagttacaataatagcaagtgatgattatcaaaatcaagtacaaaaagattccgagagcagattattgaatataggagggacagatgtgagagggaagaaagcaattttatgtataggctatattattgtggcaacgatttgcattgtaagtattgcgcttttatttttcagcaggaataagaatgagagtgaaaaatcgaaaagaacaatcggtgctttgtatatgacaatgaataacccgtattttgaagtgattaatgaggagattaaagcggttgtggaaagtaagggcgatgtgcttgaaacaagggattcgggcatggatgcgaaagtgcaggcaaagcaggtggagaaatttattgaagaaaaagtggactgtattctgattaacgctgtggactggaaaaaaataggctcttcattagaaaaagcaaaaaaagcagggattccggtgattgctgtggatgcgttgatttataaccggagttttgtagatggtacggttgtttcaaataattatcaggcaggagaacagtgtgcgaaagatttaatgaaacggagaaaaaaagggaagattctttttttagttcagtcggaaaataaatcggcaatcgaccgaattaaaggatttaaggaaacacttgagaaggctggatggaagtatgagaatgtaggagaacttgaatgtcaggggcagcttgaactttctcagccgctggtggaaaaagttttaaataaaacgaaagatattgatgtggtaatggcattaaatgatccaagtgcaatgggggcgatggctgcgttagatgcggagcatatgttatcagatgttcttgtatatggggcggatggttcgccggaggctaaaacgatgatctatgaaaataagatggcggcaacttcagcacagtcaccaagaactaccggaaagaaaactgtggaaatgctttacaaaattcttgatggaaagaaaactgaaaagcagtgcattgttcctgtttcccttattacaaaagacaatataaatgattatagcctgtcaggatggcagtaagaggaaggaggaatatcaatggaaaaaagaaaggacgcagcaggatatcagcaccagtgttttacgatgatggtattgcttaatgtgattattgttctctttcttacttttaccatcgtattgacacagtacagggtggcggcggcccaggaagcacaaaaatttattggaacgcttaaggtgatgccggaaagaccggaacaaagaatcattatggtagtattttctctcttttttttatgtgggattatttattacaagagaaaaaatgaggccgagggcaaagagaaggttttactgtggaatgtgttcgagattatctttcttatttttgtattgaaagagttagatatgtcttataatggagtgatttttcttgtagtagcggatatgctcatctatgtcgaggacaggaaaaataaattgatatttttatttattgcatttttatgttacatggtatgcagttacaatcttgtcacgatgtttattccattaaattcttttgagacgtgggctgcattttatgactggaatacagaaaggatttttctcagtgtaaagacgatttgtgagattacaaatatggtcttgtttctaatatacattgttattcttatgatgaaggaccgaagagagagagaacgaatcaagcttttaaatgaacagttgcaaaaagcaaatgaacagcttcatgagttcgctcaggaaaaagaattaatgggagagacgaaagagagaaatcgcctggcaagagaaatccatgatacgctgggacatattttaacaggaatatcagttgggattgatgcggtactggtacttatggatattgcaccagataaagcgaaagaacagctggaaggaatcggcgatactgcaagacgtgggcttcaggatgtccgccgttcggtaagaaagttaaagccggatgcattagagcgaatgtcactgaacaatgcgattcatcagatgatagaggatatgtcaaaggtcacgaacacgaaaatttactttgtttcttatatggaagaacttgaatttgaggcagatgaggaggaagtcatttaccgtattatacaggagagcacgaccaacgctattcgccacggaaaggcaacagaaatctggattcgtattagcgaaaaagatgaggagctgatgattatcatcagtgataatggctgcggttgtgagtcaataaaagaaggctttggtttaaaacatataagagaaagggtagagcttctaaatggtaaggttaactatcaaggaatgattgggtttacgattattgcgaagataccgattcgaaataagctgactggaaaaaaggatagagatgagttaaataatctcgcagacaataatgacaaagcgaaggacagtcagtgaaaataggaaagagggtattttgaaatatatcaagaaaatgtcggcaagataaaaatagaactaaaatgagatattattaaatatatcgaaaataatcaatataataaaaataagaggaatagacaatgatcaaagtattaatagcagatgaccaggaattgattcgggaaagtctgaaaattgttcttggggcaaatgaagatatggaagtaacaggaatagcggaaaacggagagcaggtactttccgaaataaaaaagaaaaagccgaatgttatattgatggacattcgtatgccaggtattgacggtgtagaatgtactcgtctggtcaaggaaaaatatccagatatttatattatcgttctcacaacttttgatgatgatgaatatatttttggagcgttaaagtatggagcaagtggctatctcttaaaaggaatttccatgaagaatcttgcggaggcaattcggacagttgtgagtggaaaggcaatgattaatccagaaattacggataagattgtaaaattatttaatcatatggcacagagcagctatgcgattcaggtggataatgaacttacagaggaattgacaaaaacagaatggagagtcattcagaaaataggatgtggaatgtcaaataaagagattgcatcggaacttgcactttctgaaggaactgtccgtaactacttaagttccgttctcagtaagttagaactcagggatagaacgcagcttgcaatctgggcggtgcaaacaggagcggtaaatagatatattggagaataaggtaattgatatagtcggataaataaatgaatttgaatatcggaggagacaataatgggagatataaagttaaaaaaagggacaggaatcctttttgtaatggcagttctttttattagcagcctgatctatctacattatggagaccagaatacgctccgggtaggaattttttatggaagcaattgggaggtccccgggacagtgcattatgagattcttgatcaggcgattaagaagtttgaatcgaaatatccaaatgtaaaggtagaatatgaaaagggcattctttcaaatgattattcagagtggctttcagaacagattttaaagggaacggaaccagacgtgtatctggtattggatgaggattttaatacattagcatcgcttggtgctctgaaaaatttagatatgttagttggcggcgataaagaatttgatttcaatgtgttttattcttctgtttataaagccggacaatatgaaggaagccagtatgcacttccgatggaatgtaatccgaccctgatgtttgtaaataagacgcttttacaaaaagagggaattaaagtcccggataatgactggacgtgggatgatttttatgacatctgtaaaacaatagtgaaagattctgatggagatggacagatggatcaatttggatgttatgactatacatggctacaggcagtatattcgaacggaataacaccatttaatcagagcgggacatcctcaaattttcttgatgaaaagttttcgcagtcgcttgaatttgtaaagcgccttgaagcaacaaatcggaattatcaggtcacatctaatgatttcgatttgggaaaagtggcatttcgtccgtttacattttctgactatagaacttacatgccatatccgtggagaatcaaaaaatattctggctttgaatggacatgtatccgtatgccagcagggccttctggggataaccgttcggagatgagtgcacttatggcaggaatgagttcaaggacagagaaaaagcaatgtgcatgggattttgtgaaattacttacaacagatacagatattcaaaaacttgtatacgaagatacctcagcagcttctgtattaaaatctgtaaatacttcacaggatacaatgaatctgctgaataaagatacaccgggagacagcataatagatatgtcccttcttgatacagcaattgatgccggagtaattccaaatcgttttgaacagtatgaagaagcttatgagaaaacagacagtcttattaaaagttatgtagatgaggagggtgacagcagcacatttttattccaaatgaagaatcaaatcgacaaaattctaaaaaagtgacaaatgtcatataagaatatgacaaattcaaattgatatcaatgacattcgttagatgtataaaaggtattgttttgttatactttaatcacaaacaaagcaagtcaaaactacaaaatgtatttctggaatctctcctatagaaatcaggtataaaagattccgtaagtacattgaaaaagggaacttaaaggagggaacgaaagtaatgatttatacggtaacttttaatccggctttagattatgtagtattccttgacaatctgaaattaggagatgtcaatcgttctacaagagaatctattttttacggtggaaaaggaattaacgtatctacgattttgaatactctcggccttgaaacaacagctcttggttttgttgcaggatttacaggaaaggcaattgaggatggactggcagcacagggaatccacaccgatttcattcatctgccagagggcaattccagaatcaatgtaaaagtaaaacatggcgatgagacagagattaacggacagggaccagtaattacagaagaagcaatcaatgaactttttgcaaagcttgatactcttacaaaagaagatattcttgtattggcaggaagtattccaaacacattgccggaagacatttatgaaaaaattcttgcaagacttgaatccaaaggaatccgtgtagttgtagatgcgacaaaagatttacttcttaatgttttaaaatatcatccgttcttaattaagccaaataaccatgaacttggggaaatgttcggaacagtatgtaaaacagatgaggacatcgtacattacgcaaagaagcttcaggaaaagggagcagtaaatgtattgatttccatggctggagacggagccattcttatcacagaagatggtcagaacattaagatgggaacaccgaagggcaaagtagtaaattccgttggtgccggagattctatggtggcaggatttatcacaggatatatccgcggtggtaattatgaagaagcattaaagagcggtacagccgcaggtagtgccacagcattttccgagggacttgcatctctggaaatgtatgaaaagatgctgaaacagattaccgaataaagtttaaaaatgctggatcaaatcagcgaatgtgctttgaatttattaaaaagttcctgttatcattttatattcaaaaagttgaatgtgatagaaactaaaatgaaacaggaatttgagataaaacaaaaaatattttaaattttttagagaggaaaaaattatgagaattgtcgatttgttaaagaaagaggcagttgttcttaacgcagaagtaagcacaaaagaacagatgcttgatttactcgttgaccttcataaagaagttggcaacatcaaagacaaagctgcttttaaagcaggaatcatgaaaagagaatccgaaggacctactgcaattgcagagggaatctgtattccacattcaaaaaatgaagcagttatcaacccaggtattgcagcaatcacagtaccatctggagttgactgtgaagcacttgacggagagccatccaatcttttctttatgattgcagctcctgcagaaggttctgatgttcatttggaagcattatccagattatctactattttaatggatcctgctttccgtgaaaagttattatctgccaaagaagttgatgcatttttagcagcaattgatgaaaaggaaacagaaaaatacggagaagaagacaaggcagcgcagacagctgaagctcctgcaaagaaagccggataccaggttcttgcagtaactgcatgtccaacaggtatcgcacatacttatatggcagccgaagcacttgaagaaaaaggtaaggaattaggaatttctattaaggtagaaactaatggttccggtggagcgaaaaatgttcttactcaggaagaaattgatgcctgcgacggaatcatcattgcagcagataaaaatgtagaaatggctcgtttcgatggcaagccagttatcaaagtaaaagtttccgatggtattcataaatctcaggaattaatcgagagagcagtaaaaggtgacggaccgatttatcatcatgaaggcggtaaggcagcaagcactgcttccgaaggagatgaaagctttggacgtcagatttataaacatctgatgaacggtgtttctaatatgcttccattcgttatcggtggtggtatccttattgcgattgcctttttgttagatgattattctatcgacccatctaactttggtatgaacacaccaatggcagcattctttaagacagccggtggtgtagcatttaacttcatgcttccaattcttgcaggattcattgcgatgagtattgctgatcgccctggtttaatggttggttttgccggtggtgcaatcgcaagtgccggaacaacatttgcttcttgttttaattcagacatcacggtaatttccggtggtttccttggagcattatttgcaggttttctggcaggttatctggtattagctttagaaaagattactgagaaaatgccaagttccatggatggtctcagaccaatgttaatttatccagttgcaggtcttttattaatcagtgtgattatgtttgcaattaacccattcttctcctggttaaaccagttacttgctgatgcattaaactccttatccggaacaaacagtattttacttggattaattgttggtggtatgatgtccattgacatgggtggtccattcaacaaagcagcatatgtatttggtacagcttctttagcataccagacggacgcaggttacatgatcatggcagccgttatggtaggtggaatggttcctccaatcgctattgccattgcttcatgggtatttaaaaacaaattcacagataatgatagaaaaacagcaccagttaacgcaatcatgggactttgcttcatctctgaagcagctattccattcgcagcaggagatcccctccacgttattcctccttgtgtaatcggttcagcagtagccggagcgttatctatggcattcaaatgtacactgatggcacctcatggtggaatcttcgtattcccagtagtaggaaatgcattaatgtatatcattgctttagcaatcggttccatcgttggagcagttatgcttggtcttttaagaaagccagtagaaagcaagtagtcacgattgttcgaataatgataaaacaataataaacaaacgaacaataaacgtataataagtgacaggcaaatgtctaataacatgtaaacatattgccgttagtcattgactggtaccttagagaatatctatcatgaagataccggccaaagattaaaaaaacaatttcttaatttagttgctataaatgaagaagaaatctcagaaacagtggaaagttactgtttctgggatttcttcttttttgacatttattgactttcttatctaaaaaaattataatgtaaataactattaaaagtcgtataagtcatataaaaatattttcccagcaagaatgccgggacattcttgaattaagcgctttaaatatgatttgtattccagataacaatacatttatatatttgattatgaatgtcagaaagcatttttgaatatactatatatgaatgtttgttttcgaaaaaagtaactgaaaagaggagggaatgacatgagatatgaaatcagcgaagtcgtaaaaaaagaccaggttatggaattggtttttggtaactgcagcaagccgaaagatttactgggacgacattttatcttacaaggacaggttatctctgcctatcatccagatgcggtaaagatggaagttatttcagaggatggcgagcgttatcctatggatactgtagaaagacagccagtattttcactgtttcttcctcataaaagaccattctcttatcagatacatatgacgtttcatgatggaaatacttatataagtagtgatccatacagttatgaagggttgattacggaagaagaagaaaaattattctcaaaaggaaactggacagaagtttatcataagatgggctgtcataaagtaaaacttggaaatacagaaggaatgtattttgcagtatgggcaccaggagcaaggcgtgtcagcgtagttggtgattttaattattggaatggaatgttatatccgatgcacaaaatggagaactccgacatttttgaactgtttattccaggactttcctgtggacagttttataaatttgaaataaaaaatgtacagggtgacataatacagatggttgacccatatgccgtaatgaatgaggaaaaggaaaacggcgcgtcaagaatgtttgatcttgggcgatttcgctgggaggattcgagatggctttccaaacgatatcatggaaatgtttttaagacaccgatgtctgtgtgtgaagtacggattagtgaattagattccccggatgagaaagtacaggaaattgtgcaggatatggggcatacacatattttactccgaggcacaccggagagagcgaaactcggagtggaaagaggattttttgagccggcattttacgggaacacaccggatacaatgcgattttttgtgaaccgttcacataaaagaaatattggagttatgttagaaatatcaccagaatatttaacaagagcagtacatctttttgagaaaaaacatccgcaggcagtcaactatcttcttgctaatatcttgttctggataaaagaatatcatatcgatggatttgtatttcggggattgagtgagaattcttctgattttcttgagaaagcaaaagaagtaataaaaaaagaagacaacagtgtactgttcattggggaagaaataaaaggaaaacagacaagagacttctttgactttgaatggaatatggaattaaaagcaggagtggaagaatatctcggaacagattttgagaagagacagggaaaatatttctgtctttcacaaccattgatgaagggagatttctctaatacactgcttttacttaataaagagaaaaataatctttttgatgaatctctcattgacaagaagccttcatgtgattatgataagttaacaggagtcaggatgtcttatggctatctgatgggagtgcccggaagaaaggcatgggatcttcattcacatgaaaatatttcttcgcaggaatatgtgaagtccctgattcggatttatcaggaatatcctgccctttatgagtatgatccactgagagcttcttttgagtggattaacgggatggatgcggagtcctctgtattaagatttatgagaaagtcaccgtcaggcagagataatctgctatttatatgtaactttggcacagaagagaaagagaactgccaggtaggtgttccgaaagctggaaagtatacaatgatttcgaatagcgatgctgtggaatttggcggcgaaggcagagacgagcatcaggaagttcaggcggtctctgaatgttgggatttgagaccatactccattaaaatatctgtgccgccactggcgacattgatttttaagttttaaagggttttatatatatttataatattagatatgaaatagtggtatgtgtttgaaagtgtttttttataaagcgagatgtgcagattgttttttgttttttcgatatgtactagagcatttttcaaacacgctataggaagagaaaggtgtgtttaataatgaaagaagattgtatattctgtaagattgcaaaaggagagattcattctgctacggtttatgaagacagccatttcacagtaattcttgatgtgaatccggcaacaaagggacattgtctcattatccctaaggaacattttgacaatatttatgatttagatggagagacagctggcaagttatttgcattggctacctgtatcgcaagagcaatgagagatgcgttaaagtgtgacgggctgaaccttgttcagaataatggagagattgcaggacagactgtaaatcatttccacttacatctgattcctcgttatgagggagatggactgaatcttaactggccacagcaggagatttctgcggagcagttagaagaaatcagacagtcaattaagaaatctatctaattattcattaattgcttatggtaaaattctggaaatttgtattttgtaagtattgatggttttccggaatgttgtttacaaaggtgattcaaagtatctgctttataaatatcagatagtttggatgaaaaaataattagggatatttatagtaatttttacaataatttcagtaatagaaaggacagagtatgggtaaattagattttaagccgggtaatatgttataccctcttccggcggttatggtatcggtgagagataaagagggaaatgataatattataacagtggcctggacaggaacggtatgtaccaatccacccatgctctacatttctgttcgcccagagagacattcctataaagcgttacatgaaacaggggaatttgttgtaaacctcactacggaaaagattgcaaaagcaaccgatttctgtggtgtccgttccggaagggatatggacaagtttgaacagactggtctgattaaaggggaagcaaagaaaattaatgctcctgtcattgaggatagtccggtaaatatcgagtgccgtgtcagagaggaagtggcacttggttctcacacgatgtttatagcagatgttgttcatgtgacagtggacgattcctatatggatgagagaggaacatttcatttagaaaaagcagcaccaattgtatattctcacgggacatattttgggctgggagaatctttggggacatttggatattctgttcgtaagaagaaaaaaaagagaaaaaatagataaattaaaacatttattttgtaataatttctgatttacaataaatcggggaatatgatataataaaatgattctaggtttaatttgaattatgaagaaaagtacatatttgtttgagatataaaatatcatgacaggaatttttgaaacaggattacaggtagtttataactattcagataaaaataaccatataagagaaggcatcgggaatacgtctttgtaaacggattatgaatagttacgataattttatttttattttgaattcatttttgtgtagagagtaatctttggaatagaaattccatttttttggttgatattttattatctgattttttgaaatgaaaatattttgattaaaaatctgttatttggatttttatgtttaaaatgaaaataatttgaatagaatttgttatttggaattttgtacaaaatagaagctttttatttgaatttggaaatttaatagaaatattataaattggatttaatttgtttaaattcctatatttatataaaaaatattttagttaggaatttattacttgaatttttttacatagaagtttttacttagaatttatttagttttacttaagtttgaaaattagtgttaagaataataacgtttagaatagattatagaggtgcgaaatggaacagtatattattaaaggtggtaatccgttagttggtgaagttgtaattggtggagcaaagaatgcagcattaggaattctggcagctgccattatgactgatggagaatgtttaattgataatatgccgaatgttagagataccaatgttcttttacaggcaatggaaggcattggagcaacgattgaccgtaagggagataatgaagttgtaatcagtggaaagaatatcgattctactggagacttaattgtagataatgaatatattagaaaaatcagagcttcctattatttaattggagctttacttggtaagtatagaaaagcacaggttgttcttccgggaggatgtgatatcggaagccgtccaatcgaccagcacattaagggattccgtgcacttggtgcggaagttaagattgaacatggcatgattatcgcacaggcagaacagcttgttggaaaccgcatttacttagatgtggtttccgttggtgcaacaattaatattatgatggcagcatcactcgcacagggtaatactgtaattgagaatgctgcaaaagagccgcatatcgtggatgttgcgaacttcttaaacagcatgggagccaatattcgcggtgctggaactgatgttatccgtatcaaaggtgtagagaagttccacgatacagaatattctgtaattccagaccagattgaggctggaactttcatgatggcagcggcagctaccagaggagatgttctgattaagaacgtaattcctaaacatttagagacaatttctgcgaagttaatagagattggagcagagattgaagagtctgatgatgcagtaagagttgtggcagcgcagcgtctgcgtcacacacagatcaagacacttccatatccgggatttcctacagatatgcagccacagatggcaattacactggggctttctacaggtacaagtacgattacagaaagtatttttgagaatcgttttcgctatgtagaagagcttcgtcgtatgggagccaatattaagatggtagaaggcaacactgcgattattcacggtgttgagaagtatacaggtgcatcagtagcagcaccagaccttcgtgcaggagcagctcttgttatcgcaggacttgcagccgaaggatatacaacggtaactcagattggttatattcagagaggatatgagagattcgatgagaagctccgtgctcttggggattgattgagaaggttgattccgagaaagaaaccaataaatttatttataaaacaggtactgtaaattaagaattggagatgaaaagtataatggaaagaagattatttacatcagaatctgtaacagaaggacatccggataagatgtgtgaccaggtttctgatgctatacttgatgcattaatggaaaaagaccctatgagccgcgttgcctgcgagacagcaatgacaacaggccttgtacttgttatgggagaagtaacaacaagtgcatatgtggacattcagaagcttgtccgtgatacaatcaaagagattggatatacaaggggtaaatatggttttgacgcagatacatgcggtgttatggttgctttagatgagcagtcttccgatattgctatgggtgttgataaagcacttgaagcaagagagaacaagatgagcgatgaagaattagaagcaatcggagctggagaccagggtatgatgttcggttacgccagcaacgagacagaagagtatatgccatatcctatcgcattagctcacaagttatccagacagctcacaaaggttcgtaaagacggaactctgtcttacttaagaccagacggaaagacacaggttactgtagaatatgacgagaatggtaaaccagaccgtcttgatgcggttgttctttctacacagcatgatcctgaagtcacacaggaacagattcatgaagatattaagaaatacgtttttgatgcaattcttccacaagatatggttgacgagaatacaaagttcttcattaaccctacaggaagattcgtaatcggtggaccacacggagacagtggattaacaggaagaaagattatcgtagatacttatggtggatatgcacgtcacggcggcggagcattctcaggcaaggactgcacaaaggtagaccgttctgctgcttacgctgcaagatatgtagctaagaacatcgtagcagccggactcgcagataaatgtgagattcagttatcctacgcaatcggtgtagcacagcctacatctatcatggtagatactttcggaacagggaagattgcagaagataaactcgtagatatggttcgcgagaactttgatttaagaccagcaggaatcattaagatgcttgatttaagaaggccaatctataagcagacagcagcttatggtcattttggaagaaatgatcttgatctcccatgggagaagcttgataaagcagagactcttaagaagtatctgtaagatgctaatctgctaagctaaggcaaaggagataggctctttttgagggctaactttggctgctggagggaaatcagaagtttgggagatacatggttagctgcactactttaaggcaagtgggagagttatttttcgacggattgtagggattagatggaacattagctgtaagaaacttttgccggattgctcaaagaaattaaaaaaagaaggggttgttctaagcttgaattttgtgactttgtgctgtgaaattctgactgtaaccttgcgagctcgttttcgagcaaggttgttttatcaggcagaatggaacgtttagcacaacggaacaaaatcaagcttagaataaccccttcttttctaaatccttctggcaagccggtcacactttctccactacagtgacgtctgtttacccgcaaatccaaaattgcatgttaaaaaataatcaattttttcaaaaaatctatttacgaatgtctttgaaaatgatatagtgtggtagtaattttatggatggtattcaaagcgaaaccatacccccatgtaactggcagatattgagcttatatctttaggaataagactcggagtatcaccgtgcgaaaggcagggtgatgaattatgagaacaggaattataggtgcagggaaagttgggtgttcccttggtaagtatttcagattaaataatctgaaagtaacaggatattacgatgtgaatgagaatcttgcgaaagaggcggcgacttttacagagacgacctttatagaagatttggagacaattgtaaagataagtgatactctgtttcttactgttcctgatgatttgattaccacagtgtggaatcagatgaaagatatgtcccttgagggaaagtttatatgtcattgcagtggtgctttatcagccggagatgcatttcccggaattgataagtgtggtgctttcggatattctgtccatccgctctttgcagtcagcgataaatacaattcttacaaagagctatcacatgcgtattttgtaatagaaggcgatgagaagcatcgggaagaaatcgccgggatttttaataatcttggaaatgaggtgcgttatatagcagcaaaggataaagtgaaatatcattgtgctgccgccgtatgcagtaatcatgtggttgcactgatacaggaaagtcttgatctgatgcaggagtgtgggtttgatgaagagagtgcgcttaaggcattagctccaattatgcttggaaatatgcagcatattgcagagcgtggaactgtaaatagtctcactggtccggtggaaagagccgatgtaaagaccgtggaaaagcatttgaactgtctggatgagaaacagcaaatgctttatcgtcttttgtcagaagttcttatttccataggagaaaagaaaaatccgggcagagattatggaaggctaaaacacattctcggaaatgagtaagactgtctgaccacaaatcatttcgcgattttatcagatgatgatttgatgaagcgaagattttgtgtgagggttgcatgacaacaacataagggacagcgaatcaggaggtatataatgaagaacacggtaacaacttttcaggcaatgaaagataaaggtgaaaagatttccatgctgacagcatacgattattccacagcaaagttagaagatgctgcaggaattaacggaatcttagttggagattcccttggaaatgttgttttaggatatgatactacaatcccagtaacagtagaagatatgattcatcatggagctgctgttgcaagaggagcaaagaattctttagtagtagtagatatgcctttcctttcttatcagacttctgtttatgatgcagttgtaaatgccggaaagattatgaaagagacacagtgtgactgtgtgaagttagagggtggaaaaagtgtgtgtccacagattaaggcaatcactgatgcttctattccagtaatggcacatcttggactcactccacagtccgtcaatgcatttggtggatttaaagtacagggtaaaactgtagaggcagcacagcagcttattgaagacgcaaaggcagtagaagaagcaggagcatttgctgttgttttagaatgtgttccagccaaacttgcccgcaaggtaacagaggcgttacatattcctacgattggaatcggagcaggagagggctgcgatggacagattcttgtctatgcagatatgctctctatgttttctgattttacaccgaagtttgtacgaagctttgcaaatgtaggggagattatgtcacaggcattcaaagattatgatgccgcagtaaaggacagctccttcccggcacaggaacatacatttaagattgctgacgaagtgttagataagctttattaatgctggattaataaatctgatattttcgatttgaaaatcgttttagtatgggatgctagagcgtgtttgaaaaatcattccagcaatctgcacaccccaatttgcggtatattttgccttcattcggttgccgtagcccactacgccgccctcattcaggcgaaatctcccgcaaattgtgatgcacatcttgcagaaagcatttttcaaacacgctctagaatcaggcattataaatatataaaagaaggataataagattatggaaaaagtatatacagtaaaagaagtaagagagcaggtaaaagcatggagaagagagggccttaccgttggtcttgtccctacaatgggatatcttcacgaaggacatgcaagcttaatcaaaaaagcagtagagcagaatgataaagttgttgtcagtgtatttttaaatcctacacagtttggaccaacagaagacttagaagcttatccaagagatttcgaggcagactgtaagctttgtgaatctattggagcagctatggtatttcacccagaaccatctgaaatgtatgcaccagatttttgtacatgggtggatatggatgttctttctaagacattatgtggaaagagcagaccaattcatttcagaggagtatgtaccgttgtaagtaaactctttaatatcgtaacaccggaccgtgcttattttggacagaaagatgcacagcagcttgctatcatccgtcgtatggtaagagacttaaatatggatatcgaaattgttggatgtccaatcgtgcgtgaagaagatggtctggcaaagagttcaagaaatacttatttaaatgaagaggaaagaaaggcagcactcattttaagtaaagctgtattcctcggtaaaaaaatggtagaagatggagagacatctgcagcagcagtaaaagaagcaatgattaagaagattgagtctgagccaatggctaagattgattatgtggaggcagtagacggattatccatgcagcctgtagaagaaatcaaggccccagtattagtagctatggccgtttatattggaaagacaagactcatcgataactttatcgtagagtaacaagtggattaaagaatatttcaagcacacgcagagttattcagagctaagtagtttatatcgaaaatgaatataaattaaaattcaggtagctttgaataatgatttatttaatattttgtaattaagaagacatagagatttttcggaggaatagatacaatgcagattacaatgttacagggaaagattcacagagcaactgttactcaggctgaacttgattatgttggaagcatcacagtagatgaggatttacttgacgcggccggtatcagagaataccagatggttcagattgtagatgtaaataatggaaaccgttttgagacatacacaattgccggcgaaagaggcagcggcgttatgtgtttaaatggtgccgcagcaagatgtgccagtgtaaatgataagattatcctcatggcttatgcacagatgactccagaagaagccaaagaaaataaaccaaatgttgtatttgtaaatgatgagaataaaatcagccgtgttacaaattatgaaagacatgggcgtttattcgacatggagaggttaggataaaaaatgttaaaaggaaaaaccgtcgttttaggagtaactggaagtattgccgcttataaaattgcaaatcttgcaagtatgctcgtaaaacagcactgtgatgtgcatgtgattatgacaaaaaacgcaacgaactttatcaatccgattgcatttgagacattgacaaataataaatgtctcgtagatacatttgacagaaattttcagtttcatgtagcacatgtgtctgtggcacagaaagcagatgtgatgatgatcgcaccagcttccgccaatattattgccaagcttgctcatggaattgcagatgatatgttaagcacaacagccttagcctgcagtgcaaagaaaatcgtatctcctgcaatgaatgtgcatatgtttgaaaatccgattgtacaggataatttaaacatattgaagaaatacgatatggaagtggtagagcctgcagttggttatcttgcatgcggagatacaggggcaggaaagatgccagatccggaagttttgtatgaatatatcataaaggaaattgcctgtgaaaaagatttaaagggcaaaaagattatggtaactgccggtccgacgcaggaagctattgaccctgtccgctacatcacaaatcactctacaggaaagatgggatatgccatcgcaaaaagagcaatgctccgcggagcggacgtaacacttgtctccggtcccgttgcactcgatccagttccatttgtgaaaatggttcctgtaactacggcacaggatatgtttgaagcagtcagcggcggttttccagagcaggatatcctcattaaagcagcagcagtagcagactatcgtccgtctaatgtcagcgatgagaaggtaaaaaagagagatggagatatggcgatcgctctcgaaagaacaaccgatatacttggctatgtcggagagcataagaagccagaacagattatttgcggattttccatggaaacacaaaatatgcttgaaaattcccgaaaaaaattaaagaaaaaacatcttgatatgattgtagctaacaatttgaaagagcagggggctggatttggaacagataccaacagggttacaatcatttcagaaaaagaagaaaaaaatctcgaactcatgtccaaagaggaagtagcagatgagattttaaactacattcttgagtttaaatagatagattttgatttcatggagacgaactctgaaccctgtatcaatagtatctgtgactttcgtcgcggcgtgttgaatactcgcttacgcgctcgtgttcaacacttgctcccaggccacagatactattgatacagggttcagagttctgtcttctggggggattcagaaaacctatcggtagttttctacttgctctggagagtggggaagaatgtagttttttggtaggatttgagggagagagctggagagtttggctggattcaagttatctatagagtagaaaaagattaaaaaactaaaaacttactatttaatagaaacccctcctgagaatccccaaatcctccccctattttataaaatttagtttgccaaagtcagaaaacaaaaaaatcatatcctagaaaatgtggcctgggagcaagtgttggatgcgagcgtgaaagcgaacattcaacacgccacgacgaaagtcacattttctaggatatgattttcctgttttcgtctcccaaacctaaaaattttataaaatatttgttaaatattgtttggtttttgaaaagttgtgttttaaaaaccaatttatgttataatcgtattacaataaagtaaataaaagagtattgtcggggaaggcagcataattgggattttctattatcaaaagttatagaagaccacaaatactgtgtgggcgaaaagtactcctgttgcaggcaggctttctttcacataagagttacaagaaagtcagcaaagaatggagaggtgtttatgaagcatattttgataatagaggatgaaagagctgttgcggaattagaaagagattatttggagattaattcttttaaagtatctattgaagaaacgggtgaaggcggattacaaagagcgttgaaaggagatattgatcttattatattggatttgatgcttcctgatatggatggatttgagatatgccgggagcttcgccatagaatagatataccaattcttattgtttccgcaaagaaaagtgatattgataagataagaggattgggcattggagcagatgattatattacgaagccatttagtccgaacgaactggttgcaagggtaaaagcacatttaaatcgctatatcagactcaccaggaaacgtattgatgtaaatgaatatatagaatacccaggattgaaaattgataaaagtgcccgtagagtcttcgtaaatgaagaagaaagattttttactactaaggaatttgatcttcttacttatctcgcaacacatccaaaccatgtattttccaaagatgaattattcagtgcggtgtggggaatggattcaatgggtgagattgcgacagtaacagttcatattaaaaagatacgaaagaaaacagagaatgcaaatgtaaagtccggatatattgaaacggtctggggatcaggttatcgttttagagttattgacagtgatgtaagtggagaaagagaaagtattgtagatgccatttgattttaagaatctgaataagtataatagaggagataaaagactgaagtaatagaggagtagtaaagaatatatgctaaagaaaaagagagttccgattgtatttgaagacgatgcagtaattgtatgtgaaaaacctgcaggtatgccggtacagagcgatcatacaagagatatggatgtgcttacaatactaaagcatcatatttttgaggagcaaaatagtgaggaagaaccatatcttgccgttgttcaccgtctggacagaccagtaggtggattgatggttcttgctaagacaaaagaggctgctgcaaatcttagcgaacagattcaaaattttgaatttgaaaaaaactaccaggcagttgtgtgtggaaatcttagagaggactttggaacttttgaagattatctcctgaaaaatggaaagacaaataaaacagaagtagtgaaagcaggaacaccgggagccaggaaagcagaactggattatgaattgattgactgtattgagacaaaagaaggagtgcttacatggatccttgtcattcttcatacaggccgtcatcaccagattcgagtacagtttgcttctcgtggacttggactttacggcgatacaaaatataatccaaagttccagaaaacgaaaaagaaatatacagagattggattatattctacaaggatatcctttaatcatccggtaactggggagagaatgacatttaagatagaaccatcaggagaagcatttgagaagatggatgtagaagcattttaaaaaatagcactgccagctatttattggtggtgctatttttgtatacatatttatgtatattttctcgctttatatagtcatattcttgacaaatcaagggagttattttacaataaaaaacagactgacagtgcggattgttgcgggaattgaagcagcaatcctttatctttgtatcataaaaaatatgttagatatcatgttatataagaagaaaggaaatattatggctaaggaaaagaagcttgtagaagcaatcactccaatggataaagattttacccagtggtatacagatgtagtaacaaaggcagagttaatttcttattctaacgtaagaggatgcatgatcatccgcccaagaggatatgcaatctgggagaatatccagaagcagttagatgcaagatttaaagagacaggggtagagaacgtatatcttccaatgttaattcctgagagtcttttacagaaagaaaaagatcatgtagaaggttttgcaccagaagtagcatgggtaactcatggtggagaagagaaacttgcagaaagactttgtgtacgtcctacatcagagaccttattctgcgaccatgtaaaggacatcgtacattcttatcgtgaccttccagttgtatacaatcagtggtgctccgtacttcgctgggaaaagacaactcgtccattccttcgttcttctgagttcttatggcaggaaggacatactttccacgcaacagcagaggaagcaaaagaaagaacagagcagatgctcaacgtatacgcagatttctgtgagcaggttttagcgattccattagtaaaaggaagaaagacagaaaaagaaaaatttgccggtgcagaagctacttacacaattgaggcattaatgcatgactgtaaggcattacagtccggtacaagccacaactttggtaacggatttgcaaaggcttttggtattgagtatacaaataaagataataaactttctcctgtatacgagacttcatggggaatgtccactcgtatcatcggtgcgatcatcatggtacacggtgatgacagcggacttgtattacctccaagaatcgctccagtacagacaatgatcatcccaatccagcagaagaaagacggtgttttagataaagcatttgagattcgtgatactctgaagtccaacttctctgtaaaagtagatgattccgataaatccccaggatggaagttcagcgaacaggaaattcagggaattcctacccgtatcgaaatcggaccaaaggatatcgaaaaaggtcaggcagttatcgttcgtcgtgacacaagagaaaagattgtcacacctattgataagattccagaaacattaacagaagttcttgagacaatgcagaacgatatgtacaataaagcaaaagcacatcttgagaaaaatacacatatcgctcataactgggaagaattcaatgacattcttgaaaaccagcagggattcatccgcgcaatgtggtgtggagaaaaagaatgtgaagaagccatcaaagatgagaatggtgcaacaacacgttgtattccatttgtacaggcaaaacattccgatgtatgtgttcactgtggaaaaccagcaaaatgtgaggtttacttcggaaaagcttattaagtcctgatttgccgcaggcaaggagacgctcccaaagagagccgataccctatatttgtgactttagtcgctgcaggttgaatgttcgctcacccgctcgcatccaacctttgctccgaggccacaaatatagggtatcggctctctttgggagctgtttgttggctgcccatgcaaattcagaatttattttgagaaagatttgagggaggcttcagactgttgtgaccttttgaggaattgaaatactggaggactgacacttatcttatcattttaaattatttgatattataactatctttggaagatttccgggctttatccattcgccttataacttttttgctttctttagcatttttaccgcaaattggggcgtgcagattgtaggaatggtttttcaaacacgctctagttaatagaaaaaagtagtgaccataaataactatacgattgtggcactgcttcaagtgtcaatcctataaaatttcatttcccggaacttctacatctcctgtcctcttccccaaatccctctaactgattttctgagctgccaacgagcagaactcctgaagataaataaagcatatttgtggcctcggagcaaggtttggatacgagcgtgtgtaagcgagtattcaaaccgccgcgactaaagtcacaaatatgctttatttaccttcaggagttcgtctgttccgtctgcctcgccagctcggcaaatcaggatttatgccaaaagctgctcttgaatttgtaatgcattgacttcaaattctgccaatgcctttgttacatgttctgcggattcttcattatagatatagagataaactggacgggaaatatcaagactaaaaatggccataatagactttgcattgacgatactacagccggatactaaatcaaaacgcccgttaaatttattaattatgtctacaaaagtttcaatcttatccaaggaattgatgttaatggtttttgtgatcacaggaaacgcctcccaaactttcaacgctaaaattaattaaatattaaagtgactgttttattgatgactattcagagctatgcaaagatgtggtaaattgagagtgcgctgaattactgtccttattcttattaataatatgttaacacctgaaaagatagttttcaagtgacggaaaagaaatttgagggtacatatttaaacatttcttatagaaagtgaacaaaatcattgttgtgataaaacaaaaaaagttcttgttgtagaaaaaataacaaatatattgataaacagaagtaggaatgagtctcgcaggcattatgtactttgctgaatatataaggaaagttaaagtactatttattttgtcattgaatatatatgagagagagttttttatacgctttataattacagtaatttcataaataaaaatttttaatttattatatgatattgggggagttcatttatgctgcaaaatgaattaaaagcaatgctcaatgaagaagagtgtattggtgttccagcagatgaagaatatcaggagtacctgatagattatatacttgacgagaatctttttgaaaatgaactttcagattactgtgtgtttccaattgggtataaccaatcgattatttatataaagtcggataatccgcttacagggggagacaggcgatttcgctacaatatgattccaaaatgttacggactgatggcatctgaggcattagaagaaacaggagttttgcgtgtacggcgttctccgcagcttggctatcgagggggcgggacactagtagcgattattgatacgggaattaaattagatgattctctttttttatatgaagatggaagttcaaaggttgtttctctgtgggatcagagcgaccagagaggaacaaggccagaaggctttctttatggtacggaatggacgagggaagaaataaataatatattacagagtgacatggatactgggagcaacagaaaggatgaaaaaaacgattcagataatataagtagcaatagtaaaaataatgttagaaaacttccgaacgatgaaaatggacacggaacttttcttgcagcaatcgcagcgggaagagaggatatagaccagattttttccggggtggctcctgatgcagaacttgttgttgtaaagctaaagcagagcaaaaaatatttgagagaattttattctattccagatggtgtatggtcgtgtcaggaagatgatgtgatgctcgcagtgaggtatgttatcaatgtggcaaataaacttggaaagccaatatcaatctgtcttggaataggcacaaatcttggggacataacggagcaaatagtttagagagatatatttcttatctttcattacttcctaaaatatcttttcatcttgcaggtgggaatgaggggattagcggacatcattttcacggaacgattcggagagaggaacagtatcagacagtagatttcaatgtagcagaaggggaaaatggttttgtcatggagctttggggagatgagccaaatgtatacacaattgggatactttcacccggcggggaaaatattgaacggatgcagcttaaaatgggagaatttcggagtgtccgctttttcccggaagatacattactggaaattcgttcatttcccggagcgaccataggcggttcgcaggtaatccgaatgaattttaaaaatattgtttccggtatctggaaactatttgtctatggaacaggaaatggagaaaagcagtacgatatctggcttccaataagcaactttttaaaagaagaaaccgtctttattaatccaagttctgagcagaccgttacctcccctggaaatgcacagtatgctctcgcctatgcagcatatgatgtggcaacaggtggtttgtacgtcagggccagcaaaggatatacaagagacggaaggattgttccagacctcgcagcaccgggagtatcagtaggtataccaggtgtttcaagaatcactggtgcgggagaaagagcaatcagcagagagcgtgtgcgtagtgggagcagcgtagcagcagcctttggagctggaattggagcactaatgcaggaatgggcatttgttgtcggatatgatccatttatgaatgggcagaatatgaggacatatctcatacagggagcagtaaaagatggcccctatgaatatccaaatcgggagtggggatatggcaaaatcaacatatacaacacactactagaacaaagattttgattgctatttaattcattaagagacagacgcccgagaagagaaccgataccctatatttgtgactttagtcgcggcggtttaaatgctcgctttatgcgctcgcatctaaaccttgctccgaggccacaaatatagggtatcggttctcttctcgggctgtctttgattggattttgattgaattaaatagtggttgtggagatttgggggagagagtagaaattttctgcttgctccaatataatatagtcaagtcaaatcatcccccctatttccagtcattttcgagtaagcagaagacatcagcttctgtccccaaatcctcccaccttctatttaattcaccttctccagccacagcacagaagccattgccccccaataaggcatatttgtggtctcggagcaagtgttggatgcgagtgcgtggagcgaacattcaacgcgccgcgactaaaatcacaaatatgccttattgggggcaatggcttcgtctgtagttcgtttaatgaattaaatagtaataaaaatcccggcatctttggttatgttaaatccgtgttccgtttttttgcgaacataattccgaaattctttataatggtcaatgatatattgattttgattaccgtgacaggaaagaacataagaaattaaagtttctggttcagtaacatataaagaatcctcataaggcagccatgttatattatggaaatatggtgcgaggagatcagctccattttcttttccaaagcgttcaaaaagccgctctgcggacagaatgatgcggtcatcgaattcggagactaattcgttgatttctttcatatgttcagaaccgtaagtgctgcatataaaaacaccgttcggttttaacacgcgggcaatttcctgaaaaacgtcagtgagatgtttgcagtaaaagagaacatggttggcaatgatgaggtcaaagctgtcatttggatatggaatccgttcgcagtcaaatacctgaaagtcaaatcgagcgttttgaatatttgaatgaatcatacgccgggtatcacgaagcattccttctgaaatatctgagagaacaacatggagatgttctggaatcttttccttattctcaagccataaagaaccatcaccgcagccaatctcaaggacatttgaatgatttttcatatggcattgttcaaaaatccacggaaaccagctttgtttatttgtgctgtacttactgtgaagctggatgcgtgcggaaatatttgatgcgttctgatattgatttttcatgcttttttccataccggtaagatgaatcaggtttagcatctggctccagtttacgctatgttcttcttcgattgcacgggaagtatcctgtattgctttttctacaagctgaagctgttcgattttatcctgcacaagcttttgctggagtttcagcgcatttgccataaaatgatagtccgaatcattgatcgtcatttcccggatatcatcaagtgaaaatcccagatattttaacaaaagaatctgctgcaggcgggcaaaatcttcatcagaataaaagcgcgcaccgtatggagtcagataagaaggctttagaatattgtgggcatcataatagcgaagtgtttttttcgtaatatgcgccatttttgcaaattcacctgaagaatagaaaccgtcttttttcatattgaaaaacctcctttgccaaagtataacatggttcaatgcattaagcaaaagaggataaaaaagtagatgtagcaatggtataaataaaaagaaaagaatatcagggaagcaggaatcaactatagcaaaaagacaaaaaaacatcagtgggccatagaggggtatcaaaaatcttaaaaattttcccttatcattctttacgatttgtgatagaataaaaaaccgtgtgtaaaaattttagaacaaaacaaaaggagtgttgaaaaaatgaattccgagaatgcatttaaacagcttggacagaaactgatgaacggggaaattacacctgaggaacatgtaaaagaatacaataggcttttaaaagagatgtcagagaaatacgattctcagtggcgtcctcacgagcatatttaatataaaaccatgggaatacaaacatttttgattgtttgcccgttagtatttttggcgggctttgtagatgcgatcgctggcggtggcggattgatttctctgccggcatatatgtttgccggtgtgccggtacataatgcgattgcgacaaataaattatcttcatgtacaggaactgttgtctccacctggcggctcataaaaaataaaagagttgactggtattttgttccgggaacagtagtgtgtgcattagcaggctctgtgatcggagcgaatcttgcactgattatcagcgatgagattttaaaaacagtattggtagttctcctgccaatcgttgctttctgcgttcttcgagataagaaccttgaagtgatagttcctgaaggaatgacaagaagaaagcagtatatcattgctgcagcctgttctcttggaattggaatctatgatggattttacggtccgggaacgggaacctttttattacttgcctttacgaaacttgctaaaatggatttagaaaaatctacaggaaatgtaaaagcagttaatttagcttctaatatatctgcccttatcacatttatacttgcaggaaaaatcctgtggacattagggctggccgcctcatgttttagcattgccggacactacactggtgctggaatggtgatgcataatggggttaagattatcaaaccaattattttggtagtattggtgttgctgctgataaaagttatatcgggaatgtagttaaaaataaattttggtttgccacaggcaaaaagatgctccccaagagaggtctctcttggggagttgtctttggcgttttttttattttctttagtatttttattacaagacatctttctgtgtctcctgtcttcttccacaaatcccttcaggacttcgtctgttctgtctgccttgccagctcggcaaattagaatttcgtattgattttttcttccccttactgtactcttattacaagaaatcaggttcaacccctttgccgaatgaactgaaaattgtagatactatcgtattgaaaggatgaaatatgaagaaaatcttactcgaaaaactgttagataattgtaaagaacaggagtatcaaaagcaatatgaatatattataaacctgctggaagaaaagaagattaagccagtaaaggcttcaagactaaatggaaaaagcccagctctttatcgggaatactggttgttagaggagacaaaagattatagtaattttattgaagaattaagatatcagattataccggacatttctgtggattattatctgagacatttggaaagttatgaggcagaccgggaatgggtattgcaattgaataaatatttgaaagaaagaaaagagacacttcagtttaaagtatcggcgaatgaacgaagttttgaaatctggggaagggaaaagttcttgtctaaggggcagggaaggcggattttaaaacgatgcgggctggagatgtctttttttaatatctatgaaacgacggagccacttgcttattattcccgcacaagaaatgtgccgcaaaatcttctgatattagagaataaggatacattctttagtatgcgccgccgccttttagagggaaatgagacgatactcggaataaagatagatacattaatctatggagcgggaaagggaattttccgcagttttgaggactttgatttgtgtgtggaaccttatatgaaagcagcgggaaaccagatttattattttggggatctggattatgaggggattgggatttatgagaatttgtcagcagattttggtgaaaagtggaatattgttccgtttgaagccggatataggaaaatgttaagtaaggcaaaaggtgtggatagtattccagaaacaaaagaaggacagaataggaatataaaagatattttcttttcttatttttctacggaacaggtaaaacgaatgaaagaaattttggaaaaaggatactatattcctcaggagattttgaatatttcggatttttaaatggattttatacaggagaaggagaaaatgcaatatgaatttttaaaaaaatttcctcgaaggatgaaaaatgtaggcctatatgctgtcattatacagaacagcagtcagaagttatcatggaaacagtatggattcacaaagttcgatgaacagataaacctgctatttgaagtgttgctttacattatggaacagtcactaaaagaggaaaaatgtacgatggatgatatagcgacctatatagatacgattaatgtgcagtatctaagaaaggatatttcttatgaacaatgtcatcaacttggggattttatcgtgaatacagtattgtctaatgaggggcggccgatgtattttgggggatatgatttcgaaaaaaatgaatatgaagagatgcatatcagttatgtggctaacaaaattgtctatgtggagaatgaggtcaggcgaacttcatattatctgaccgatgatggttataatcttcttttgtctacattggaaatagaagataatatgaagtttaatattcatgagattattttcaggcttcatttggaaaaacaaagttatgacaaagcggtaaatgatataaaaaacgtgtttaaccttatgagaatacagtttcagcgagtgcaggaagcaatgcgccagattcgcaggaacgcattgagttattccgttgatgagtacgaagaagtactcgttggaaatctgaatacaattacggatacaaagaaaaaatttcaggaatataagacagttattcaggagcgtgtaaaagatttagaagaggaaaatattaatatacgtaagctaagtaaaaaggaacagcaggatttaaataatctccgggtgattgaggagtatctgacaagagttcttgatgaacatcagaaaatcttgaacagtcattttgatttaaaaatattgtatacagaggaattggaacgcttatcacaggcaaggctgatacagcgtttttctatgagaagagatttatatgataaagttttaaaacaggcagatacattggaaaatatggatatgtttttacggcctctttttaatagaaatcctgagaaaatttataatctgaacaaagcattttcttacgaaaaatcagtaaatgccggaatggagaaagataccgaggaagaagtggattttgacgaggaagcatttcgcagggaaaaagaagaaaagttacaaaagaagcttttagtttatgaaaagagcctccaatatttattagaaaaggcatcggttacgggagaagtttctttaggacagttaaaggacagattggacatttatccagaagaaaaagagatttttataccaaatgtcgatgtatttaaagagattatggtagaattgatccgaaatcgaacgatagatatcgctactctgaaaaaagaaagaagagaatatattcaggaacagccagatggatttcagcttaacgaaatgattttaaaattagtggaagaacagccggaaaataacgatataaccagcattgaagtagagcggctggaaaatgaagaagcgattacattttcagagataaaagatgaagaaaatcggaggaaaacaatacgctgttctaatgtattaatacggatttttaggaaatagtcaggattaaaaaggcaatatcagcaattaattcaaatacatagatatgtgtttttgataatttatgctgattgaaagggataacattgatagttgatttaaacgtattaatctatatttttgaaaatgaggagtacgaacaatggcatatacaatggaagatatcagaaagagtcaggagatattttattatcttttggaaaaacacgagcttcgggaagaagatgagcaagcgctgtacaaggcatatacggaggaagaagatattcagaatatcgtgaaatcgcaagctgagaccgcatcctgtgatattgagcgttatggtaacacgatttatctgattccacaggaggaaaataattttctggggtattcaagagtagaacttaagaaagagttgtgtaaatcaacagcgacaaataaagactattatctggcacagtttgttattctgacattattaacagaattttttgatggtgatggaaacagcagcagagcaagagagtatattcgttccggtgaacttatgaatattttgtcggagcgtctgagagagggagccgcctatgaggaagagcataacgaggaagaaatggatactgcgggaatttcattttctgatatgtgccatgcatatgaagcgttaaagtcagatgataaaggttctcatgcgaaaacgacaaaggaaggctttttgtataatattcttcttttccttcaaaaacagggacttattgagtatatagagcgggatgaaatgataaagacaacgaaaaaattagacagctttatggattggaatctgttaaatcagaataattatcagagggtaaagaatatattgggggtgattgaaaatgagcaaaattaatgcggttcggtttatcaatcttaactataacaataatgcgatgaaaatcaatgatgaatgtatgcagtttagcgggaaaagtacacttctttcattgagaaatggcggcggcaagacggttctcgtacagatgatgacggctccttttgtgcatagaggcaagcaaaaaacaaaggacagaccgtttgagagctattttacaacagcgaagccttcttttattttggtggagtggctgcttgatggtggagcgggttatgttcttacgggattaatggttcggaaaaatcaggaaattagtgaggaaaaaacagatgcgcttgaaatgatggcaattattagtgaatataaagagccttgtatgcaggatattcaccatttgccagtagtagagcaaaatgaaaaaacgatgaagttaaaaagctataattcctgcagaaagctttttgaggactataaaaaagataagaagctttcctttttttgctacgatatgagcagcccggcacagtcaagacagtatttttataaactgatggagtatcagattaattataaagaatgggagacgattataagaaaggttaatgtcaaagaatcaggattgtcagaactgttcagtgattgtcggacagaaaaagaactggtagagaaatggtttttagaggctgttgaaagtaagttaaataaagaggaaaataaagttaaaaattttcaggaaatactcgaaaaatatgccggaaaatataagaatattaaggagcagctaaagagaagggatgccattcagaaatttaaggaagccgctgaagaaatacagataaatgcggaagattttcttgtaaaagagggagaaaagatagagcaggaaaaagtaatcgctgcttttatagcacgattaaatgtgttgtatgaagaagcggaaatagagcgggaacggcaagaagagggcagaaaaaaattgcaggaagaattagaattcttaaaatacgaacaattatcctgtgaatttcatgaaaaaaacagagaaaaaagaaatcatgccagcaatcgtgagatgatagatttagagaaagaatcgcttcttagaaaacaacaaaaaatacagaagaaagttcatgtatttctctgtgcaaaacagcaggagatggtcaatgaggataaacaggaatgggaaattcgaaaggaaaaagctgcaatctcccgtacaaaagaggaaaatttagagccggagagaaacagaatcggcggacagttaagtggatattatgaatatcgcttaagtgataataaagaaaaaaaggaggcgataaaaaaacaaaagcttcagataagaaaagacatttcacagcagaaagacattttaaatgaatatcgggaaaaaacaaagaaaataacagagagtaaaggaagtttccggagtctggtcaggggttacgataatatagaaataaaatataattccaattataaagagaatctttccagaaatatattgggagtatatgaagcaggaatgcttgatataaaacaggaaatgtatgataaagagcagaaaaagagcattcaggaaaacaaggaacagaaagaaaaatccgaaaatacgactgaggagattcacagaacggaaagagccattgaagaaaaaagagaaaagtattttcagaaagatagtgatataaagcaggcagaaaaagagaaaaagggatatgaacaggagcttgaggaaagaaaagacattcttaaatatcttgaattgccggaagaaaagctttttgccagagaagaaattctccataaggccaaaataaaaatgcaggagcttagtagcaggagaagaacgctggaaaagaaagaagatgcattacaaaaagagtataaactcttagtcagtggtcgggtaatggaacttccagacaacttgaaagaagaatttgaaaaattagatgttccggttgtatatggaatggagtggctgaaaaagaatggatttacagagaagaaaaataaagaaattgtaagccaaaatccatttttgccatatgcacttattttaactcgtcaggaactaaaaaagttatcagaaagaaacggagagacatatacttcatttccgatacccattatagagagggaaaatcttgaatctataaagttagatagaacacaatcttttgtaaaaatgcaggatattcatttttatattttgtttaatgaaaatcttctggatgaagaaaaaatggagattatgatagaacaaaagcaaaaagatattgctgacattcgggaaacgatgcaaatctgtaaaaatgaatatgaagactatttccatcgttttgatgtgataaaaagacaggcagtaaccaaagaaaactgggataaaatacagaaaaaactacaaaaactggagaaagaaaaagaagacattttccagaatatacaacaggcaagagatacaaagcaaagcttaaagaaaaactttgaaatcctgcaaaaaactcttagggaattggagaagaaaattgaatcacaggcagccagacaacgcgcatttaaagaacttagaacggcatatgcagagtatgaggaaaataataagaagcttcaggaatatgaaagagaagaagaacgattagaaaatcgccaacatcttacagaagaaaaaatcagccagcttgaagaaaattatagagaacttagcggacaggagaatagtctgttcagggaggaagagtctattcagaatgcctgtcagaagtttgcagcgtataaggagataaatagaaatgtaaaagcaggtaagcttttaggtgtagattctacgttgaggacagataataattcaggtgtaaaaatcattccaagtgaggcggaagttcttaaattagaagcaagatatgaagcggttactgcagacatttcccaggaattaaaagagttagaattagaagaagaaaaggccctgacccgctaccacaaatctttcggagaattacgggaactatgtcaaaaatataatctgaaaaactcagaatggcaaaatatcatttatgacaaaagagagcagctttaccaggaggcagagttagaagattacgataagaaaatagagcgaaaagcaaatcttctaaatgaggaagataaaaaaataggaattttaaacagccagttagaagggattttaaagcagatagtatcagaatgtggaaaaggaaatcctttagaagaagaaaaaatcagccagaaagatttagaaagtgcaaagaaccagacgaaatatcaactcagcgaattagagcggaaaatagcattttctgaaaaagcaatacagaaatacagagagaatctcacagcactttctgaatataataatttttccgcagatgaagaaatccattttgagcaggacttcaaaaaaatgagtgaaaaggaactgcgtgattttaagggaatgttgatcagagattataatgatataattagatgtgttcagaaatgcagagaaactcttgcacagacattaaataaaatcgcgagacaggaagcatttcaggatgcaagttataaaacgcctcttgaaaatatgcttaaagtctgtgacgatgcagcgaaagttttacgtcagttaaacatcaccctggaatcctatgattcacttatgaagcagttagaagtagatatttctctggtagaaacagaaaagaaaaatgtaacggaacttctggaagattatgtccagaatattcataaaaaccttgaaaagataggacgtaattctacaataaaaatacgggaaaaatcaataaaaatgctaaaagtcattttaccggtatgggaagataatgaaaaattatatagcctccgcttaagtgattttgtggacgaaatcacagaagaaggtatccgtttatttgaaaataacgaaaatgcccaggaatatatcggaagaaaagttacaagcaaaaacttatatgatactgtggtgggaactggaaatgttcagattcagctttataaaattgaagaacagagggaacagcagatcagttggaaccaggtagcaaaaaactcaggaggagaaggtttcctgtctgcatttgtcatattatcaagtttgcttgactatatgcgaaaagatgattctgacattttcatggacaaaaatgaaggtaaagttttattgatggacaatccatttgcccagactaatgcagaacatcttttaaaaccattaatgaatcttgccgataaaacaaatacacagttgatctgcctgacagggttaggcggcgaatccatttataatcggtttgacaatatttatgtactaaatcttattgaagcacatcttagaaatggaatccagtatcttcgtccggagcataaaaagggagaagaagtaaaagtggaaacgatacttccaacacatatagaagtggaagaaatgctgttttagttcgcagggagacgccccccaaagagacgatagcctatatttgtgactctatccctgcgggttgaatgttcgcttataggctcacattcaatcctcgctctaaggccacaaatataggctatcgtctctttgggggagctgtctttggctgtagaagtaaaatcagatttcatgttggagggtttggaggatttatcagcaggttgtagatttacgggaaatgagatattaaagattgacacataaattataattacagtattgaagtgatttttcacgattcctatttctcctgtccccatccccaaatcttttcaactgatttgtaggattggaatacacagaagccgcagcccctgtaatatgtaaaaatgcgccttagagcaagtccaaattgcggatgagcagtttgggcgcagggaaacgaagcatttttacatattacaggggctgcggcttcgtctgtgtattcctccctcccctgcaaatcagaaatcacttgattatgcatagtaaatatgataaattcaaaagttagagacagttgtaaaaataataaggagattgaaatatggcaaatataatttcagacgaaacaatcgaatatgtcggtattcttgccaagcttgaactttccgatgaagagaaagaacaggcaaagaaagatatggcaaatatgcttgactatattgatacattgaatgaacttgataccagtggagtagagccaatgagtcacgtatttcctgtaaataacgtattcagagaagacgtagtgaccaatggagatgatagagaagagattctggcgaatgcgccggaagcaaaagaaggagcttttgtagttcctaagacttttgattaggaggaaagacatgggtttgatggattatacagccgttgagctgggtaagaaaatcaaagcgggtgaagtatctgttttagaagctgcaaatgcggctatggatgcgattgacgctttagaagataaatttaactgttatgtaacggtacaggaaagagcagcagtgcaggcaaaggcagaggaacttcagaagaagattgatgatggaactcttacaggccctcttgccggtgtaccagttgcagtcaaagacaatatgtgtacaaaggggactcgtacaacttgtagttctaagattcttgaaaattttgagccagcttatacagcagaagcagttttgaatcttgagaaggctggtgcccttattattggtaagacaaacatggatgagtttgcgatgggcagtacaacagagacttctcattatggagtgacaaagaatccgtggaatgcagaacatgtgccaggtggttcatcaggcggttctgccgctgccgttgctgcaggtgaatgtagttatgcgttaggttccgatacaggtggatctatccgtcagccagcttcttactgtggtattgttggaatgaaacctacttatggtactgtttcccgttacggtcttatcgcttacggttcttctcttgaccagattggaccaatggcaaaagatgtgacagactgtgcaacgattcttgaaacaatcgcttctcatgaccctaaagattctacttctgtaaagagagaagattatgattttacttctgccttaacagatgatgtaaagggaatgcgtatcggtattcccagagactacatgggagaaggccttgacgaggaagtaaaggcagccgttcttgatgcagcaaagaagttagaggaaaaaggtgctatcgtagaggagtttgatttaagccttgttcagtatgcgattcctgcgtactatgttatcgcttctgcagaagcaagctccaaccttgcccgttttgacggtgtaaaatacggctatcgtacagaaagttacgaaggacttcacaatatgtataaaaagactcgttctgaaggatttggaccggaagtaaagagaagaattatgcttggttctttcgtattaagttctggttactacgatgcatactatttaaaggcacttcgcacaaaagcattgatcaaacaggcatttgataaagcatttgcaaaatatgatgtcattttaggaccggcagctccaacaactgcaccaaagcttggtgaaagtttaagtgacccgattaaaatgtatcttggagacatttataccatttccgtaaaccttgcaggtcttccgggaatcagtgttccgggaagtctcgacagcaaaggccttccaattggtatccagttcatcggtgactgctttaaagagaaaaatatcattcgtgcagcatatgcatttgaacagagccgtgaatttacaaactggagtctgagcggaaaggaggaaaaatagaatgagtaaacaatatgaaaccgtcattggtctcgaagttcatgtagaacttgccacaagaacaaagattttctgtggatgtagcacagctttcggcggtgcgccaaatacacatacatgtcctgtatgtaccggaatgccaggttctcttcctgtactcaataagcaggttgtggaatatgcggcagcagtaggtcttgcaacaaactgcacaatcactcagtactgcaagtttgaccgtaagaactatttctatccggacaacccacagaactaccagatttcccagctctatcttccaatctgccgcaacggtcacgtagaaattgatgtagatggcagaaagaaaaatgtacgaatccacgagattcatatggaagaagatgcaggaaagttagtacatgacccatcaacaggtaactctttagtagactttaaccgaagcggtgtacctttaattgaaatcgtatctgaaccagatatgcgttccgcagaagaagttatcgcctaccttgaaaagcttcgtatgatcatccagtatcttggagcatctgactgtaagcttcaggaaggttccatgcgagcagacgtcaacttatccgttcgcgaagtgggagcagaagagtttggaacaagaacagaaatgaagaacttaaactcctttagcgcaatcgcaagagcaatcgagggcgagatggaacgtcagatcgacttaattgaagatggcaaaaaagttgtacaggaaacaagaagatgggatgatgacaaagaatattcctacccaatgcgttccaaagaagacgcacaggattatcgctatttcccagaaccagaccttactccaatcgtaatctctgacgagtggttagacgaaatccgcagccgtcagccagaattccgtgatgaaaaacaggcacgttacaaagaacagttcggacttcctgaatatgacatcaatatcattacagaagataagacacttactgatctctttgaatcctgtatcgaacttggtgcagcagccaaagaagtatccaactggatcatgggagacattatgcgtctcttaaaagaaaaagaaatggaagcatccgacatccatttcagccctgcaaaccttgtaaaaatgattcaaatgatcgaatctggagcaatcaaccgtaaagtagctaagaaagtattcgaagcaatctttgacgaggacgtagatccagaagtttatgtagaggaaaacggattaaagaccgtcaacgacgaaggcgcattacgaaaagtaattgaagaaatcgttgctaacaatccaaagtctgtagaagactataaagcaggtaagaagaaagctatgggattcttcgtaggccagacaatgagagcaatgaaaggaaaagcagatccagcgatggttaatcagattctcaaggagatgctggattaattctggcttactcaggtgaacagacgacctcagaaaaagaaataatccatatttgtgactttagtcgcagggtttgaatgctcgtttaaagcgctcgcatccaaaccttgctccgaagccacaaatatggattatttctctttctggagtcaggctttgcctgcggcaaatcaaaaattagaaaggattattatgtgtgaaaagaaagttcctgtattaaattctatgattaaaaaccgaaatacacgttttttgaaaagttatacactgaattatacgaataccgaaggcaatgagaaactctacgaaatggtaagtaatttcgattatgaaaaaccagaggagattgggcagaatgcctctggtgttgtgattgttggtttctgggatgatgagcttttgctgttgagagaattccgtatgggtgtaaaccagtttatttacaatatgccagcaggacattctgaagatggtgagtcagtggaggaatgtgccaggcgggaacttagagaagaaactggattgcacattaaaaaaatctgcaaaatacttccgccagcttatgcagctcccgatttaagtgattcatcagcatgggttgttatagcagaagtagaaggtgaattcaatccgcagacggaagcggacgaatatattcagccattatttgcagataaaaaacagcttaaagaattactggaaaatgaaaaattctcagccagagcacagttaatagcttatttttttactatttaattcattaagagacagacgcccgagaagagatacgatattctatatttgtgactttagtcgcggcggtttaaatgctcgctttatgcgctcgcatctaaaccttgttccgaggccacaaatatagggtatcttctctcttcccaggctgtctttggctggattttgtttgaattaaatagtggttacgggaatttgggggagagagtagaaatttcctgcttgctctgaaattattgtgaacagatgctttacatttaaattgaagttataaaggttgaaaagggaaattgaagcttacttcttcttgctccaatataatatagtcaagtcaaatcatcccctattcccagtcattctcgagtaagcagaatacatcagcttctgtccccaaatcctcccactttctatttaattcatcttctccagccacagtacagaagccagtgaacttcataagccatatttgtggtctcggagcaagtgttggatgcgagcgcgtggagcgaacattcaacacgcagcgactaaaagcacaaatatggcttatgaagttcactggcttcgtctgtagtttgtctaatgaattaaatagtaaaacatccttttatagtaccatgcaaatgttcgttttttgatgctttgtctggcataaattggatagctgcgataaggtttcgaatcaatgtagagcacgactgaacctacggcagtacctttttgtacaggagcagttaaggaaggggacaggctgataatacagcgagttttttccgtaggggaaatgtacaagctggtggaagcgggagcggaaagcgtgcaggtagatttgcggccgttttttactggaagtttagaaggaattccctggtttaaggggatttcttttttgttataattttttattccatagtccatcagtttttttgtatcttcccatttatagcggcggttaggataccaaccactgcccagcacgacagagattaaataatggccgtcttttttaactgcgcccacaaaacagtaaccggcattgttggtgtagccggtttttacaccgattgcgccattataggaagttaaaaacagatttttattatttaaagagtaagactgcccattttttagctctttaatggaaaaagactgttctttaataattttacagaagttttcattttttagggcaagacaggttaacagagcaagatcatggcaggtagtatagtgttttgcactatctaatccgttaggtgtttcaaaagaagtatgatagcagccatagtctctggcttcctgtgtcatatcctcacaaaattgttcgacggagcctccaatatgttccgcaatcgcaacagcgacatcgttgtatgattcaagcattaatgcatagagcagatcggacaataaaaattgtgaaccgcttctggcaccaagccgtactttaggagcagaagccgcccttctcgaaaaagtaactttatctgaaagatttccatgttcaatggcgtacaggcaggtcatgatttttgtcgtacttgccatagggagttctttttcttcctctttgccaaataaaactctttgattatctccatccataagaatggctgctttcgcatggagtgaagaaagctcagcaggggcagaatttttggacgcattatcttttactgatttatcagataccgtaaaatttctaatcgtttctgtttttgaaaatgcatagacatccagataacaggaatcagcaaaaaatatagtaaaaataaagaaaacagagaggataaacaacaatgaaaaagcacaggttttatatttgaaaatacgttgctggtgattaaaatagtggttcaaaaaagcacatcctttttagaatagtgggttttctataactatgagaaaaaaagaaaaaatatgataaatagtaatttgccgcaagcaaaagagactctcttcgggggcgtctctttgcctgcggcaaatcagaattgcattgttcatatctatgcgatataattaaagccataaaaaatagcagaaagaaactgaggataagaaatggcagcaattaataatgactgggcggaagctctgaaggaagaatataggaaaccttattatagagaactttacaaaaagataaatgaagaatacagaacgcgtgagattttccctccatcagatgagatttttagtgcatttcatctgacaccattaaagaatgttaaagtcgtgattttgggacaggacccatatcataataatggacaggcgcatggacttagcttttcagtaaaaccgggagtggatattccaccgtcactggtgaatatttataaggaactgcacgatgaccttggctgttacattccaaataatggataccttgtaaaatgggcgaagcagggagtccttttgctgaatacggtacttactgtacgggcgcatcaggcgaattctcatagaggaatcggctgggaagagtttactgacgcggcgattcgtgtgttaaatgcacaggacagaccacttgtatttttactttggggaagacctgcacagaataaaaagccgatgctcacgaatccgaagcatttgattttggaagcgccacatcctagtccattatctgcttatcgtggattttttggatgcaggcattttagtcaggcgaatgagtttcttcgatttcatgagttagagccgattgactggcagatagagaatatttaaatgacaggtagagaatgtttaaataatatttaaagtaaaaaacttcggtttttttataagtcgagataaatcacattaagccggaataattcgcatttagaagggagacaaaatgaaagtattatttgtagagtatccaaaatgttcaacctgtaaaaaagcaggaaaatggttacaggaacatggtgtcgggtacgatgacagacatatcgtagagcagaacccgacagcagaagaacttaaggaatggcatgagaagagtggacttccattaaaacgtttctttaataccagtggacaggtttaccgcaataatggaattaaggataagctgccaggaatgagtgaaaaggaacagtatgctttacttgcgacagacggcatgcttgtaaagcgtccaattgttgttggggaggattttgtactggttggatttaaggaaaaagagtgggaagagaagttgtagaaagtatttttcaaatatgctctgggaaattaagcgagaatccccgacaagtcaattgccggggattttacaattacattctatctatatattctctaatcctgttaaaggtggaatatctggctgtatttctccagccgattccacggctttccagataggctttctgattttattttttcttcaacgattcccgatgaatcctatcagcaattgccagtatgtaattctgtataatattttccgttccgcattcagcatccgggtgtaagacggcaagttttaataattcattggcagcaatacgacattccgcaaaggataaaagtccccagcttaactggtcaagtaaatgtgcatacagagaagtataggttaccagtgtatcatctgtccggatgcggtccaatatatcggtgaattctgcacggatcagattacggtatgtttctttgtagcagtcccacaaggcatcttccgttacaccaaaacgatccattcggtgaataatatcatgttgtatctgtggagtgattccctgctgcagtttcagtgcttctttgatagaagagatgacagtacgcccaataagttcacccagcttactgtgctttccggcgttagtaaggtgggtctttgattctgcatttgatataataatagcaccatctgttcctgttccggtagcaatcccacaggagtagcggctggcaatcagaagttcctgcatagcagcaacctttgcctcagtgcaggaaacaagggcagaagccagggcttctttggaaaggtctgcatcaatgtaaagaaggatattaatagttccgactggtaatttatctttatctgaaataattttacctgaaatatttttacctaaaatattcttagtaagattttgaatgggatttttcttttttgtgtcagaagatgtggtatcttcaaaagtattttccgacttttcgtgccatgaagcaggatcaccgatgcggccgccattgtttcggacacctgctgtagcaatagatgttacagaaaaatcatcataggccagcgtggaaatggcggaattatccatgctggcaacggtcataagtccggagcaggaagaagggtcaagacccaaatcttcctttgctaaaatatccatatgctcccggtaagtatccgcccgaagtttaacctccatgccatctccgggatttgcatcattattaaacacggcggctaaatcagttgtaaatccaccattatttggtccggtactcaagacattcctttttcctttaaaagaaatgacgatagattttttatatttatgcacagtatcgccacttggaaattcataaagtttcaaaataattcctcctgattggtcagtttatctttttattgtatcattttattatagctgattcataaataaatgaaacaggctgccatttgccttatgttatattatttttcggagcttcaaagcttctgtccaacgtaatgatacaatccacgttcttttccatttcgtgaaggagtgctataagctggtgcataacgcggtttgcgtctttttctgtataagaatctggaacaacaaggtcaaaaatcagatttttctgttcattttcctttaaaacacgaaaatcatgaaaatgcagttctgggtcaagtgcatgaacaatgtgggacgttttatcgcgaagttcgagtacttcttcatcacgcatttctaccgggtccatgtgaatcacaagaagaatattaagttcctttttcgcgtcacgctcaattcggtcgatgatttcgtgagatgcctcaatactgacatcgttcggtacctctgcgtgaattgtcgccatactgcgatttggcccatagttgtgaacgattaaatcatgcgctccgacaattccttcatatgattccaccatgtccgttattttctgataaagctctgacggaacacgttggccaattagtggctctaacgtatcttttgcaatggaaacacctgaccagattacaattccagaaacaatcagtccggcaatcgcatcgacattaatagaagtaaaatgacagataacaatagaaataacggtagcactcgttgtaataacatcaccgagagaatctgcggctgtcgcaagcattacttttgaatcaattctttttccaagtttattattaaaaaatgccatccataactttacaagaatcgataaaataagaataataaatggaacagggtcaaatgtaatttcctctggatgcattatctttgagatagaacttttaaaaaaggtaaaaccaacttcgataacaagaaatgaaacaatcagagcggcaatatattcaatccttccgtgaccgaaaggatgctctgcatctgccggctttcctgccattttcacaccaacaaaactgataattgaagaagcagcatcggataagttattgaaagcatctgcggtaacagcaagagaacttaaaataagaccaatggcaagcttcacagaaaaaagcaggacattgcaaaaaatcccaacaacgctggcaagcataccatagcgagttcggacttctgtgctttcgatattggcactgtcttttataaatttgtttacgagaaactcagtcatataaaaacctccatgtgttaattacgatatctatttaactatagcagtttgagaggaaaagttcaatgataaatagcaattccatccctagccaaaacacagccctcttttgataaataaagcatatttgtggcctcggagcaagtgttggatgcgagcgcataaagcgaacattcaacacgccgcgactaaaatcacaaatatgccttattgggagcaatggcttcgtctgtagttcgcttaatgaattaaatagtaaatttctgttgcattttgttgaaaaatcccatatagtagagttagaagaatgacaaaagaatcaaatttttgtaattatctgaattaaatccgcgcaggtatatttgtgagttttttgttttgaatagttgcagatttacaagagaaggaggcgagcttatgttttatcgttgtaaaagctgtggtggtaatgtaatctatgatccgaagaagaaagcgatggtgtgtgaaagctgcggaaacggaggagaaccggatctgatttcacaggagaagaagcatgtctgtaataactgtggtgcagagattgaagcagataagattgatttatcgctaaaatgcccatattgcggaacctatgttatttttgaggacaggatggagaatgagtacgaaccgaatctggtactgccttttgcacttgataagcataaggcattggatcttttgaaagaaaagtttgctaagcagatgtttcttccaggcaatttttgtgctgcctccacaatagaatcaatgcagggtctctatgtaccattttggatgtatgatttacatactcatgtgcattttgaaggagaagcggataaggtaaggacatgggacgaagacgattatgagtgtacggaaacaagcacttaccgcattttaagagattttgatgtggattatgataagattccggttgatgcctcaaaagtaatgcctgataagatgatggatttgatggagccatataagtacggagagctgggcgattttgatgcgaagtatttgtcaggttttcaggcagaagtgtatgacgaagacaagaatactcttttgccaagagcgaaaaagaaagcagataagtacagccagaagtatcttagcagttataatgtagaatacgatgcagtaagaccgacagtgaatgataagaagagtacggaaaaagaatccttttattcatttttaccagtatggcgttatgtgtaccgctatcaggggaaaaattatgaattttatgtcaatggacagacaggtaaggcggtaggagaagcaccgacaagtaccggaaagattatcgcatggtttatcgccgtgtttggttcccttttcttcactgtggaaatgttgctttatttattgggggtgttataaatggcaaagacataccgtggaatattaatatttgttgttatacttggaattgtgatgggactggccggcaaaaagtttgacggctatgtatacacaaatacggaacctcgcagcaatacagaatgtacattgactcagagagtatttgatgatgcagatgtgcttactgatgaggaagaggcaaaactggaaaaattgatagcagagaaagaaaaacttatcggtggagatatcgttctcatgacaacaaatgatgcaagtcttaacacgatggagaagcttcgggattatgcacagaactactataaagagaacaaaatcggatgggataagccaattggaagcggtgctatctatgtagatgactgggagacaagacacacctggcttgccactcgaggaactgtcaaagataagttatccaaagacaatacagattatattgtggatgaaactaatgatattgtgaataaagacccatataaagcctacacacggttgataaatctgttggcagatgagacacaaaagagtcatcttttccatataaatatcagtccgttatgggtagcacttggctgtcttgttgcagcaattgctttcgtagtattccagctttctgattccgtaggtaaggataccgtcaagaagtctacctatgtgaaaaaagatggcgtacagttaaacgataaacaggatgtattcttacactcccatgttacaaggacaaagagagaaaccgaaagcagcagtagcgactgcggcggcagcgatggctttggaggcagtggcggttctcactaaagcgtgtttgatatgttgtattttcgtctataaaaaacaaaggaggcccccatgttttaccgttgtaaagattgtggtggtaatgctgtttacgacccaaagaaaaagaaaatggtatgtgaaagctgcggtaatgaggaaacgtaggaaaaaataccacaggagaagcttcatatatgtaataactgtggagcggagattgaatccaaaaagacagatcttgctctgaaatgtccatactgtgggacctatgtcatttttgaggacaggatgaaagaggagtacaagcctgatctggcattgccatttgtgatagatagaaaagaagcgatagagattataaggaagaattttgcgaagaaaatgttcattcctaaagatttttgttcgacttcaagtctggaatcccttcagggaagatatgttccattttggatgtatgatatggagacccatgtgcattttgaaggagaaggaagaaaaatcagaacgtggacagaaggagactatgattgtacggagacgagcatatatcgtcttgtaagagattttaatgtgaattatgataagattcctgtcgatgcatcgaaaaatatgccagatgagaaaatggatttagtggaaccttataaatatactgcattagggaagttccgctcaaaatatttgtctggattccaggcagaaatttatgatgaaaataaagaagaacttttgccgagggcacagaaaaaagcaaagaaatatacggaaggttaccttgatgagtataacaatagttatagcagtgtgaaaactgctattaaaaaagtagatagtaaagaaatgaactcctactatacatttttaccggtatggcgttatgtataccgttatcagggaacaaattatgagttttttgttaatggtcagacgggaaaagcaataggaacgccgccgaccagcaaggcgagaatgttctcatggtttgcagcagttacattttcgttgttctttcttgcggaaatgattctgtattttctggaggtggcataaatggggaaaatctggagacgaattttaataggaatcgttatactcgctgcgattataggcatcgtggcaaagttgcttgagccggaagaatacaccaatacaaaacctcgtcaaaatacagaatgtacaatcacgcagagagtattggatgaagcaggcaaaatgacggataaacagaaaaaagatcttgaagctttgattgcagaaaaggaacagctaattggctgtgatattgttattcttacaataaatgagccggggcttgatagttatgatgaaatccgagactatgcacaggcatattatgaggataataaatttggctggaataaagccaatggggacgggatcatttatgtggatgattgggaaacgggatacacctggatgtgtacaactggtcttgcaaaaacgagactcgatgatacggacacagaacagattgtggatagtgccaacgaaatcgtaaatgataatccatatgaggcttacacatctattgtaaataatgcagcaaccatgattcagacaggccgttcctcttatgtgcagattaacccgattattgtctttcttgcagcagcagtaatcggagccatttttgtaggtgtccagttaatcggacatggaggaaaagacactgttctaaggtctacctacgcaaaaggtggagtgcaaatgaatgaaaagcaggatatcttcctgcattcccatgtgaccagaacgaaacgaccgagtaaaagcagcggtggcggaggaaaagtcggaggaactggaggacatggcggagccggaggaagacattaaataggaatttgccggggtgagtagacagacgaagtctgagaatcaaatcatctatatttgtgattttcgtcactacgagaagtcatcttctaagaaaaggccgacatgaaaagttattgattttgactcagttgtacaaaacacaaagtcgtcaaaatcaataacttttcatgtcggccttttctaatattttattatagtctcgtagctcccagaccacaaatatagatgatttgattctcggacttctgtttcctggctgcccgggcaaatttgcggaaagatttgtggaagaagtcaggaggaatagaagtaatctgggaagttaaatattttaggattgacacacaattaataagaaaaaggagtatatcatcggtgtactattactgataatccgttctcagcaaaaatatcatacatgcatctgttttaatatgttttcagcatactacaacaataattcaagtatcagtccttcaaaaaacaactccacagaaagccacatccttctggagcctattcaaatccctccagtaataaatagaatttccctccccagccaaagcacagcccccgaagagagtctagcccttatatttgtggccacggagcaaggtttggatgcgagcgcttaaagcgagcattcaaaccgccgcgactaaagtcacaaatataagggctagactttcttcggggggcgtctctttgcctgcggcaaattcctatttatactttttctgcaccggatgtttttagatggagtcttgtttgtactgttgatttataaaatcgtagtaatatttcttctagttgttttgtgaagttctctttgttaagactttgtaatgcttttaaaagtgctggttcttctaagagcgcaccgattacctcactggttaccggggcagcaacttcacttgcaggtcccgagggaatcagagatacaatagcgccccggataatatgtccacgttcatagattggtggttcaagccggacgtaaccgaagcaggaggtagaaatttctgtacttcttccgtgaaggagaagtgcctgaaatggtttgatataggtatcagccaggttatctctgtcttttaatattttgtataaatgtgcctgcatgtcggaagtgtcggcatacagggaggaacagtaagagattatttcatctctgtttttcaggattggagcctgattgatgtaaatattgccgagcagttcatagatttcgcttccaatggcggagagaaattctacatcttttctacagattgaggaatcagaaggaacttcgggttctttgatttctttttcctgtgcctgccttttctgttcctgaatgactttgatgcgggaatcgagcagtattttatcctgacgggttaatattggattgacgtggatgtatgggtaggcaatctctagctttacagtggagataacaaggtcaacgccttcttcctgtaatcgaatattatctaattcaaaagcggaggttataccgcggatatcaaggtcagggtattcttttttcaagctctctgtgagaagtcttgaacttccgattccagttggacagacaatcataacagaaagctttttgatttctttttcaatacgttccattgccattgtgaaataaagggtaataaaaccaatttcgctggcgggaactttttttatgccaagaatcggacagaggagagaaagtccctcttcacaagccttatatacagaaggataactttcctgaaattcctttaacagcggattttctacagggattccagcgcggagtctggcaatggtcggttggatatgtccgcttaattctgtgaggagccggctgtctctcataaagtttatatgtaaaatttcgttgactttttttatgatggacagggtaatctgatgtacgtcaaggttttttatatcagttaaatctctgcttccagatggccatatacgctgtccggaaataaagacagccatatagatggtctcatcgacagaaatagataaatggaaaaactggcgtaattccttcataatatattcggaaacggcatactccggctggatagatatttctgcataagactgtttgagttctttgataaaccgtcctttttgcattctctgtacacagagggaagtgtatacaagcaagtgtaaatatccattgtcagaaagctgcataccaagctgtttctgacagccgccaaggatgtgattaacctcggccattacttcgccatcaatttcattgataaaatttcggtctgacagaaacttcttgtcctggagattgccaatggagtgatgttcatttacctgtttacatatgaaagaagtcaatgcctgtcttcttgcgatttctgttccttctataaatacaccaagtccgggacggcggacgagctttagctgatactttgtaaaccaggtttcaagctggttaaggtcagcagtaagtgtaccctcggaaatctcgaacttttctgtgaagtagtaagatttaatcggctcttctgcgaggagaaggtcatgacataagagagtcagcctttctgggcggttatctgcaggagcggagctatttgtatctttttcatctaaaagagcagctaactctttcaatcgttctggtgtctcgtcaattaaaagtcctacacttcgtttgcgtacaaagcaaaagccattatgcttcatccatttttcaacggttggcagttcgcgctggacggagcggtcgctgacaccgagttcttctgaaatgataccgattgtcacagggctgtccggtgaaaagcggagcagaatgcggattattttatctgcgcgtggtgtgagctgcatgattttttcttcctttcctattcttcttcttattatacaatattttactgacaaatacttcttgtgaaaatgcacaaaagagcgacaaagaaattgggtatattgatgataaagtgacagtttgtcgggaagtcttaccgacaaagttgcggtatcattcctttgaattttgtcattttgtgctttacaatagagacatagaaaacaagggcagtgcaaaaaagcacagtgtcaatatcccaaggccggaggcaaaacgtaaaacggaaacaggtattaagccgatggggaggggcaaaaaagagaggagatatgtaacatgaaaaacgcagtacaacgttttggtaagttccttagttcaatggtaatgccaaatatcggagcattcatcgcatggggcttcatcacagcattatttatcgaaaaaggatggcttccaaatgcacagcttgcaactttaaacggaccaatgcttaattacttacttccagtcctgattgcattccagggtggtaagttaatcggtggagaccgaggcggagtaatgggtgcgatcgcaaccatcggtgtaatcgtcggagcacctgattatccaatgttgatgggtgctatggtaatgggtcctttggctggttttgttattaaaaagtttgaccaggcaatggacggaagaatgccagccggatttgagatgttaattaacaacttctccattggtatcttcggtatgttattagctatcgttggttactatgcaatcggacctttcatgagtgccgtacttgtagtattaaaaggtggtgttcaggtacttgtagatcatagtcttcttccactcgcagcaatctttattgagccagcgaaggtattattcttgaacaacgcaatcaatcatggtatctttactcctatcggaattgaacaggcagcagaagctggtaagtccatcatgtatatgttagaggctaacccaggtccaggtcttggattacttcttgcttactgggcattttctaaggataaagcaacaaaggattccgcacctggagcaattatcattcacttcttcggtggtatccatgagatttatttcccatacatccttatgaatccattagtaatcgttggaccaatcgcaggtaatatctgtgcgatccttttctacagtattacaaaagcaggtcttgtaggaccttccgcacctggttccatcatcgcatttatgtcaatgtcaccaaagagttctatcgtaatcacagcacttggtgttctgattgcagcaacagtatctttcttagtttcttcaccgatcgttaagatggcaggaagcaagagtcttgaagatgcacagaaaaagacaagcgacatgaaagctgagtccaaaggacaggcagcagaagttctttccggagcagatgttaaggcagatgacattaagaaaatcgtattcgcatgtgacgctggtatgggatcttctgcaatgggagcaacaaagttcagaaatcgtattaaacctttaaatcttggaattacagtaacaaatacatccgtagataatgttcctgcagacgcagatgtcgttgtatgccagtacattttacaggacagagcagttaagagtgcgccacaggcaagattagtagcaatcggaaacttccttcaggatcctaaccttgatacattctatgcagagttagagggacgtgcaaatggtacatccgcctcagctccagcagtagaacctgaagtaaaagaagaaaagaaagcaaaaaaagccgttcttaaaaaagaaggtatcaaaacaggcttaaagagtgtagataaagaaacagcaattcgtgcagcaggccagcttttatgtgaccttggcttcacaaatgaagattatattcaggcaatggttgaccgtgaaaatatggtatctacatacatgggtatgggagttgcaattcctcacggaacatctaatgcaaaagaaaccgttaaaaaatctggtatcgtagtaatgcagtatccagaaggtgttgactttggtgatgagaaagcatatctcgtaatcggtattgcaggtgttggtgatgagcatcttgagattcttggaaacatcgtagcaagtcttgaggacgaagaacttctcgaaacactgaaaaagaatgctgacgttgacactatcatgaaaacttttggttaaaataaataacaaaggtgagtaattaaattaagtaaaaactatattaaaaaatcatattgaaataacatcgggaatagtcccgaggtttagatttaagaaagaaggagtcagattatgaaaaaggcagttcagtttggagcaggtaatatcggtcgtggttttattggagctttacttagtcagtccggttatcatgtagtatttgcagacgttgtagacaagattatcgataaaattaatgaggataaaacatacacagttcatgtaatggacgtagaatgtgaagatcagaaaatcgaaaacatcagtggtgtaaattctacaaagccagaagcagtagatgaaatcgcaagtgctgaccttgtaacaacagctgttggtcttgttattttacctcgtatcgctcctacaatcgcagcagctatcgaaaaacgtatggcagacggaaacaaagagccgatgaacatcatcgcatgtgaaaatgcaatccgtggaacatctcagttaaagaaagctgtttacgaaaacttaagcgaggaaggaaaagcatttgcagatgagtatgtcggattcccagactgtgcagttgacagaatcgtacctcctgtaaagagcgaaaacttcattgatgtagtagtagaagaatactacgaatgggatgtagagcgcgcaagcttcaagggcgagattccagaaatcaaaggaatgactcttgtagatgacttaatggcatacattgagcgtaaattattcacattaaatacaggacactgcatcacttcttatcttggaaagcttcgtggattcccaacaatcgatgcagcgatcgctgatgaagaaatctatgacatcgtatctaaagcaatgaaagagagtggtgacggactcatcaagaaacatggtttcgaccctgaaaaacatgcagcatacatcaaaaagattatcggacgtttcaaaaacccatacttacaggacgatgtaagccgtgtaggtcgtgagccacttcgtaaattaagcccaacagaccgcctgatcagcccattaacaacagcagcaggatatggacttccagtagaccacttacttgttggtgttggtgcagctttacactatgataatccagaagacaaacagagcgttgaacttcaggcaaaaatcaaagaacagggcgttcgtgaagcagcaaaagaaatcactcagcttacagatgaaaagctgttagatgcaattgttgctgaatatgagaaattagcttagtttttatacaatataacacaaccgtaggacacacggggatagctcgcttatgcttagcacagtagtgttatcgaacgagaaccaaacttgccgaggttgggaagcccccacctctataggacgccactgaaaaagtggtaagtttagtatcacagggcgtcaaatatatgccaaaatgttccttgataataaaatattgctaaaatagtgttttgagggatgcaaaatctatccttttgagagatgaattttcctattttttctcatttgggcagacttctccctttagttttaaaattcgttttaaattgactgcaaatattgatactgctccttgaagttgcatgtttgatagtccagcagcatcacaacgactatatccgtgtatattttttaattcactattttttgcctctatcatatagcgggttttgaaacgttccttgaaatattgtgttttttgaaacgcctcttgatttttatgataatccgatttaatagtgatactatacgttttggtttttgcattttctttatagcagccattacgataaggacagacatggcatttattaatatcgaaaaaatatttgatacgtgtattctttttctgattactacgtttgtcaattcgatattttatagccaaatgccctgctgggcactgcatggtatccgcatctttattaaagataaagccgtcctctgaacgagtcccttttatgatgctcgggttaagctttgaaattaatttatagtcattgctttgtgcatcttttaaattttccagtgtggaatatgcggtatctgctattacttcattaacggttgcacctgctgctttacttttttgaaccagtactggaagttcttgaccatcaaatgcttcgccggatgtgattgttgctgcagtgataatccgttcatctgtcatggccaaatgagttttgtatccgtaaaaagaagaattgaccgttttatggccaatccgggcatccgggtcaatggattgatcataacaatcaatctgattatccaaaatttcggataacatagaagattcttctttaatcgttggcagttctgaatacggactttcctgaactgtgtttaataattcatgacagtattcattatactcatctaaagaagctcgtttttcagattcatctggcagataaatgtctttatcagaatcttttaaagctacttttaaagaagtagaggcttttttcaacatttctctctgagtagttttatgataacgggcttctgtatgagttgagtcaacaattatagtattgctttttaaaacaccttgatttatggcaagttctacacttttatttatgagcagatcaagtatattttcatcttttaaacgctgctttctgaatttggttaaaagactaggatggataacctcttcttctggcgttaattccagaaaatatttaaaagacatatcatatcgtgatctttcaacaacaccattatcagaaaggttataaagatattttaaaagcagatatttaaatagcaatatagggttttttgcattacgtccattatcaaggcaatatttattttttaattcatcatatataaaagaaaaatcgaccaattccctgatttttcttagaatatgatcttttggaacaatcatgtcatataaatctgaataataactaaggctaagtttaagttgggatgataacatttcaacctccgacaattatgataccttaattatatcagatatatgattttacgaccactttttcagtggcgtcctataggtgagggaggatgtcacttaaacgggtaaaagttatatggttgttgtgagtctgtaatatgttaagtaatttggaataaaaataagcagagggaataagttttaatattagaaaagtagctattcagagaaaagcagtatttattaaaaagggattacgggcaaactgcaagtactctgaatagctgcatatataacaattgtagaaatccgacagaacaaagaagaaaataaattaaaaccggatactaacctaataaaaataacaaactgtttccgaaaaaatcaggaaagtgaattggcgcgtaaaatcttgccttttcccgatagccatgctacacttaaggatgaaaaatttaaattgtttcaatcattttaacttttaaaggagattatatatgtgtggaattgttggatacactggtagagaggcggcagcgccaattgtactgaatggtttatcaaaactggagtacaggggatatgattcagccggagtagctgttttcaatgaagctgagaatgacatagacattgtaaagacaaagggacgtcttaagaatctgttagagaagacagacagcggaaaagcgatgccaggtggatgtggtattggtcatacccgttgggcaacacatggcgcaccttctgagaagaacgcgcatcctcattgtagtgatgacaagatggttgttatggttcataacggaatcattgagaactatcaggaattaaaagaccatctcacacagaaaggttatactttctattctgagacagatacagaagtagcagtgaagcttatcgcttattactatgagaagacagatcataacccattagaaagtatgtcaagagcattacttcgtgttcgtggttctttcgcactgggtattatgttcaaagatcgtccaggtgttgtttacgcagcacgaaaagacagtccattaatcgttggacagaatgaaggtggagcatttatcgcatctgacgttcctgctatcctttcttacacaagaaatgtatactatcttgataacatggagatggcagaacttcacgaagacagcatccgtttctttaacatgaacggtgacgagattgaaaaagaaatggttaacattaagtgggatgcagaagcagcggaaaaaggcggtttcgagcatttcatgatgaaagagattcatgagcagccaaaggcactcaaagatacaatcaatacatatgtaaaagacggtaagattgatttaagttctgtcggtatttcaccagaagaatttgcacagtatcatagaatttgtatcgtagcctgcggttctgcttatcatgttggtattgcagccaaatatgtgatggaagacctcacaggattaatagtagacgtagatttcgcttctgaattccgttaccgtaatccaaagctttcccaagatacattagttgtcattatttcacagtcaggagagacagcagatagccttgcagcactgcgtcttacaaaagaaatgggagtaaagacattagcaatcgttaatgtagttggttccagtattgcaagagaagcagaccacgttatgtacactttagccggacctgaaattgccgttgctaccactaaggcatacagcacacagttaatttgtatgtatatcctctccatgtacgctgcacaggtaagaggagagattgaagaatctaccctcaatagcatgctcaaagagatcgtgctccttccagaaaaggttgcaagcatcttagcagataaagaacgaattcagtggttcgctaataaatttgcatccgcacacgatgtattctttatcggtcgtggacttgattacgcaatctgtcaggaaggaagcctgaagatgaaagaagtcagctatgtacattccgaagcttatgcagcaggtgagttaaaacacggaaccatcagcctgattgaagatggaacacttgtaatcggtgttcttactcagagtcacctttgcgagaagacactgagtaacatgcaggaagtaaagagccgtggcgcatacctgatgggtgttgcagagaacggaagttactaccttgaagacatggtagactttgttgtatatgtgcctaagacagatccgcattttacaacgacactcgcaattattccattacagttaatgggatattatgtaagcgttgcaagaggacttgatgttgataaacctagaaaccttgcaaagagtgttactgtagaataattctgggttactgcaggcagggagagacgctcccaaaaagagaagatatcctatatttgtgactctatcactgtgggttgaatgtttgccttcgggtttacattcaatcctcgctataaggccacaaatataggatatcttctctttttgggagctgtttttggtttagagcgtgtttgaaaaaccattcctctaagagggggtctgctttcctgtggcaaattttatattttaaaggataaggagattattatggagataaaaacatttcatggatttgaagatttctgtgtagagaagtttgaaaatactgatgagtggtattacggtatttatccaacgtggatgtctaatgtggaagtagcggaggaatgtggaaaaggaagagagtatgctggaagtaagttatgcttttttaataaaactggcaaggcatatgagtcgataaaacaggagaaaaatgtgtatctggaggctcctgtgtatgacaaggcaagcaattcttttgggattttgagatatgattttaataaaagaatccttcaggcgattgcctataaaccagatgaagaaagtgttgaagtaatcgaagaaatttcgctttcggaaattgatgacttaatgaatatcagattaattgaaagcccctttatgattgtacgaaatagtatggaagaaaatgccatagaatttttggctccgaaacgaaaaatatatctggaagaaaatgaaagcattgagtttgtagaaaacgagaaaatgtatagttctaaatggaatgaggatttactggatgtattgaattatggatatggagaagaggtcatcgtaagagatttagagacaggaaagattctggaaaggtataaaggatatctgaacagaatgccagatgggacagcatggcttatgacagaatagagttggaaaaagtaagttttaacttggttatatcaataaatttatatggaaaagagaaaattagatgtaggtaaagaatgcttctgggtaaaatcagaggcatttttgaatataagatagaagataagtttaaaattttaaatggaattaagttttgcgctgtttttaggaaattaagcgagaatttccgccaattcagttgctgagtagttcaccaatttttgaagtaggataagcttaaaaaataaattgagaatttccggaaatttgattttcggctctgttttgtctataggagcattagtagtgtttactgtgatacagattgataggcctgacattgtaacaacagaaatgaaaaagctatctttatcatcacaggaaccttttacgttgtttatatgcttgcttattaattgtattagtttgtttttggtagccaggtttacaaagcagatttttgaatggatagagctaagtgaatctccatttatcccccaaatatcaaatcagattaataaaatatcggcagcgttatttgtttatattattgtcccaactggttcagttaatgaaattaatctttcttctgtagtattgggaattgtgattgtgcttgttttgtattgcctttcggcagtattcaaatatggatgtagtttacagaaagaagtagatgggatgttgtaggtgaagtatggcaattatattgagattagacagggtaatggcagatagaaagattaatttaaaagatttatctgagcagataggaatcgccaatgtaaatttgtcgaagattaaaaccggaaaagtaagcgcaattcgattttcgacgttgaatgctatttgtaaagcattggattgccagcctggagatatcttagaatatcaggaggatgaggactgatttgttaagttggtatatatacgagctggcgaaacagatgaatcctcactctctgtaatataaaggagaaaatttatgaaaaaatatctaaatagaatctacacaatactcttaattatcctttgtgtagttttatgtgttttacaaatacaggcagggacattattgagtacaggtacaataataagatttgtgattatatttatagcatatggtctgggaatggcatataagaaaaaatcctgatttgtgagtctgtaaaacagacgaactcccgaagataaatggtgtgcatccccatcaaatctttctcaaaataaattctgagtttgcataggcatccaaagacagctcacagtaaataaaagaacctatatttgtggcttcggagcaaggtttggatacgagcgtgtataagcgagtattccaaccgccgcgactaaagtcacaaatataggttcttttatttactgcgagcgtctctttgactgcggcaaataagaatttaactacttaaacagtggagccaatgcagcagctaattcatcctttgttgcctgagcgtctgcaagatcctttccaagtgtagtaaaatatgtcttaatcttaggttctgtaccagatggacgaacaacaacagttgcgccattatcaagaccgtatgtaagtacgttagcagctggaagtccagtagcctctgcattcttataatctgttacgctgacaaccttcttatctccgatagatgtaggtgggttatcacgaagtccctgcatgattccagacatcttatccatacctgtaagacctgggaattcaaaactgtctacaacatttaagtaacggccatattcagcatagatttcttcgagtctttctttgatggagcttccgatgcttctgtagtaagcagccatttcacagatgagcatggagctgattacagcatctttatcacgaacgtaaggtccagctaagtaaccgtaactctcttcgaaaccgaagatgaagcggtctacttctccagcagcttctaaggaagcaatctggtcaccgatccatttaaatcctgtaagtacacttctcatctctacaccgtaatgagcagcaacagcgtctgcaagtggtgtggaaacgatggatttcactgcgacagccttctcaggaagtgtgcctaattctttgcggcctgcacagatgtagtcaagaagcagaacacccatctcattacctgttacaagttcataagaaccgtctggacacttcatagcaataccaacacggtctgcatcagggtcagtagcgagcataagatctgcaccagattcttttgcaagatcaagaccaagctttaatgcttcaaaaatctctggattaggataactgcatgttgtgaaatatccgttaggatattcctgttcaggaacgatagtgatatctgtgataccgatgtcatttaatactcttgttacaggaacaagaccagaaccgttcagtggactgtatactaacttaagaccagcagtcttgcaaagacctggacgaacctgacgtgcttcgatagcttcatagaacgcattcttacaatcatctcctacaaaacggatgagtccctgctcaacaccttctgcgaaagaaatgtattttgccccggtaagaacatcagtcttctgaatctcatcgtatacgatagcggctgcatcatcagtcatctggcatccgtcaggaccgtaagctttgtaaccgttatacttagctgggttgtgagatgcggtaaccatgatacctgcgttacactcatagtaacgtgtagcaaaagaaagtgctggaacaggcattaatgcatcgtaaatgcgaactttaattccattagcggcgagaacggcagcagcagtcttggcaaaaacatcactcttaatacggctgtcatagctgatagcaactgtctggttgccaccctgtgttttgacccagttggcgagaccctgtgtagcctgacgtactacatagatgttcatacggtttgttccagctccgagaacacctctgagaccagcagttccgaacttcagtgcaactgcaaaacggtctttaatctcgtcatcatttccctcgatgccggcaagctcaggatgaagatcactatcttctaagtcagcagcaagccagcgtttgtactcgtctaaatacatattgtaactccttccaatgttaaatgttagtgctttaaaaagctcgttttatgtatctaattttaccatatcaggtactatttatcaagatgaaattatgtatacttttggaaaagaacacgaatcattacagataaaaagagaaaatgaattgtacagaaataccattgtcgtatatttgagaaaaatgtaattttttctttactttgtagtgggaatcaaaaatatttttgcagaaattcaaagaaatagttcgcaaacataagccgttctgtgttattatatacaatatgtgacatttgtggtatcacggaagtcacaaattaaaaagaaaaggagagtccttcttattttaatagtataatgaagtttcataaggcagatatttagagaacggtacattagagaatcagagatatacttgagaagtgtatatagacgtatcattgttgaaaattttgaatgaagttagagcgtgtttgaaaaatcattccagcaatctgcacacctcaatttatggtatattttgccttcatttggttgacgtagcccattacgccgctttcattcagttgacgtagcccgctacgccgccctcattcaggtaaaatctcccacaaattgtgatgcacatcttgcagaaagcattttttaaacacgctctagcgatacctcataagtatatgtaaagcatgcagatcttacaataaaaaagaaatcgttttgttgtgatattgtatgttgaacgctcatagacagtaatttgtctgcttttaattttattttaaaactctattagtatagaaggtacaggaatcatgtcagagaaaattattgcagtttccgcaggaagagaaatcacagaaacagaatttaatgaatttttaagcaagcttccagaacagcagcaggcttatgtagcaacagaagaaggaagaaagcaggcattaactcagtatgcaaactacttcttattcgaaaaacttggatatgacaaaaagtatgaccaggacgaagctttccttgctacaatggaagctgttaagagagaacttttaggacagtacgctttaactcaggagattaaagatatccaggcaacacaggaagaatgtgaagcatactataatgagcataaagcaatgttcgtaaaagaagcaaaagctacagcaaaacacattcttacagcaacagaagaagaaagtaagaaagtattagaagaaatcgagagcggtgtaaaaacatttgaagacgctgcaaaagaatattctacatgcccatctaaagcacagggcggaagccttggaacatttggccgtggacagatggtgaaagaatttgacgaagctgtatttactgcagaagtaggcaaagtaatcggaccagtaaaaacagatttcggatatcacttaattcgtgtagatgagcttacaggtggagaacagtctgaatttgcagaagtatatccacagatcatgcagcagctcacaacagaaaaacagaacaaaaagtatatggcagtacgtcaggaaatgatcgaaaaatacggtcttgaatttaagtaaaaatttaatataataatataggaaatcccgttctgacaggaataaatcaccagtaattacctgattattcaggcttcgtgaattgctgacggtggattgagataatgataataataagattattgcaaaattatctttatttttttctgaactggggttataataggttcgtataacttagggcgatgctaccatacatcgacaactgcgcaagcagatatttatatttatggaggttaataattatggcattagtatcagcaaaagagatgcttcagaaagcaaaagcaggacattatgcagtaggacagttcaacatcaacaaccttgagtggacaaaagcaatcctgttaacagcagaagaatgtaaatccccagttattttaggtgtatccgaaggtgcgggcaaatatatgacaggatacaaaactgttgtaggtatggtaaacggaatgttagaagagttaaacattacagtaccagtagcacttcatcttgaccacggttcatatgaaggagctaagaagtgtatcgaagctggattctccagcatcatgtttgatggttctcatcttccattcgaagagaacgttgaaaagacaaaagaattagtagcaatctgtaacgaaaaaggaatgtctatcgaagcagaagttggttctatcggtggagaagaagatggcgttgtaggaatgggcgaatgtgcagatcctcaggaatgtaaagctatcgctgatcttggtgtaacaatgttagcagcaggtatcggtaacatccacggaaaatacccagaaaactgggctggattacagttcgacgtattagatgacatccagaaattaactggagaaatgcctctcgtattacacggtggtacaggaatcccagaagatatgattaaaaaagctatttcccttggcgtttctaagattaacgtaaacacagaatgccagatttctttcgcagaagctacacgtaaatatatcgaagcaggcaaagacttagaaggaaaaggatttgaccctcgtaagttattagctcctggtgcagaagcaatcaaagctactgtaaaagaaaagatggaaatcttcggttctatcggaaaagctgaataattatagaatgtaattgagctactatagaaattatggtagtaactatacttcaaaagaaaaaggactctaccgatggcgtggtatcgtttttggaagatatacggatatatctttctttattctactacgtttgtgaggtagagttcttttttgtttagaatatttcattaagaataaattataagtattgttgaatatgggacaatatggaaatataatgtttatggtatcttcattctcgtcagggaaaataataaattgatattagaaaagttctttattatttaaaaggagttaactattaaaattgacagctctttaagaaatatatactgtattatttatgaggagagataaagatgtggcaatggcttttcatgtagagtatagtgaaaataagattgattaaagacaaattctgtacaaggagaattgctggttaaaaaacttggaagtctttgagcagtataaaatgtattacggagaattttctgatagaatagaagaaaggtaagaaatgactaatttaaataatgattttatggaatcttataaacatctggataaaatatgtaaagaaatttttaatagtgagaaaggtgttactacatatatagatacgatgaaagaagtaaatgatggaaatagatatgtccctttatggaataaaacgctatataagttaaaacattatagacatattagaaataattatgtacatgaggttggaacatcacaatatgatatttgtacaagagacgatatagagtggttaaataatttttataaagaaattatgaaaactacagaccctttggctcggtacaggagagaaaagagttcatataaagctgtcgaggatgttaaatatatcagatatacggaaggaggagaaggggagcaactacaatatcagaatgtaaactctaagagcgatgatggtgaaggtttacgacttttaaacattattttaaagtttcttataataatgggaatcaatttagctgtggttttgtttataatgcttatgataagttaatggaagataaaactaaatttgattcttcaatttagcaatagaaaaaaactgtgtaaaataaaaaaattttatttaaagaattgatgaaaaaacagaaaaataaaagtataagttagagactgctggtacagattctaccttatactttttatttttcgtctgttttcttcaattcaattaattcagtcgatcatatattttggtttcttcatagagccagtctgccagttcattattataatctcccggcaggcatcgccatgtccagtttccgcccagcgtagaaggtgtattcatcctgccttccactccaagtccaagaaaatcctgcatctgcataatcgcagtattggcaacacttgcccaggcacaacgcatcataccaatatgataaccttcttcttttgtaagacggaggtaacgaatagcattgttttggaattcttccggagcggtttcaaaccagccaagaatggtatcattatcgtgtgttcctgtgtatacaacgcaattatttggataacagtgtggaagataaccagaaccagtatctctgctgtcaaaggcaaattcgaggactttcattcctggaaatccagtagatgccaaaagctgttttacggagtctgttaagaatccgagatcttctgcaatgataggaagtttaccaagtttgttctcaatcgtagtgaataaatccatgccaggacctggtttccaatatccatttttggcggtggaatcaccgtatggaatggcatagtattcatcaaatccgcggaagtggtcgatgcggatcacatcgtagatttttgactggtaagcaatgcggtttacccaccattgatatccagtttctttcatgtagtcccagttgaaaagagggttgccccaaagctggccgtcagcggaaaatccgtcgggtgggcatccggcaacttcgattggacaaaggttttcatcaagctggaattcttccgggtgtgcccaaacgtcagcactgtcgtaagaaacataaataggaagatcaccaataatttttatattattttcttctgcatatgcttttaatttgtcccattgatagaaaaacaaaaactgaacctttttccagaacaggatttcatcggtaagttcctggcggatggcttccagagaatctttttctcttttctggagagtttccggccactcctgccaggattgaccgccgtagtaatctttaatcgacatatacaatgcataatcatttaaccagacgttctgttctttacagaaagtctgaaaacgttcagaaagtaccccggatatgcgggaacatgctattcttaagatagaaaatttatggctgtagagcaggctgtaatctactcttgctggattatcaccccaggaaatagaagcatattcttcttcctgtaatagtccttctttttttaagtcatcaaagtcaatcatatatggattgccggcataggaggagaaggactggtaaggggaatccccatatcctgttggacatatcggaagtatctgccagtatgtctgtccggcacgatgtaaaaattgtataaaatcacgcgcacactgtcccagtgttccaaccccgtaaggagaagggagggaagtgattggcattaatattcctgcggttctcataagagacctcccgttttgtttatatttttattgtaatgttaaacatagtgctacactatcttttattgttttatgaaattgctatagtgttctgtcttttgaattggaaaataatatttatttatctccgttcaattccataacactttcaccttcaatcaaatgaaatggtgttgttttatgtgttgcatgataaggataattaattcgctgcagcatcaggtcaactccctttttagcgagctgtgttgtgtcctgttgtacagttgtaaggcggggtacgcagtatctggaaagtgcgataccatcatatccaacgatggaaatgtcttctggtactctttttcccatgtcatagattgcacgcattgttccaagggcaattagatcactcattgcaaaaatagcagtgatagcagtattacggtttaaaagccgcatagctgcctgatagccctcttccatggagaagcggcaaggctcatattgcagtcgctggttaaatgaaagtttgctgtttttaaatccccattttgcaccggtaaatctgcggaaactgatttctgtttcggtcagattaccgccgaccacaccaatagaggtatgtccctttttagcaagatactcaatgacggactgggcagcttgttcatcacaggttgtcacagaagaaagattgtcaaagtccagatcactgctgttgttggtcaataaaaggcaggggatgtggatgtgtgcaaaatcttctttaaaatattctaagttaccacctaagaaaacgattccctttgggttgcggtcgcggcaaagctggatcgcatagtttacttcattggcgtcttcatctatataataggtagaaacattttctccattctttaagaagagagactgcatctgttctacaatgtcagcaaatagcaggttagaagttccttttacaataagaatcacagaggaactggactgcattttcagatgtcgggcattactgtttggctggaaattattttcttcaatcacgctcaatattttctttctggccttttcgctgacatctgggtgattatttaaaacccgggatacggttccaataccgtatcccgataaacgagcaatatctttgattgtcatacgcattaccttccaaataaatgatatgtaatatattaccctttaactgctccggccgcaacacctttaataatatatttctggcagcttaagtagaatacaataacagggataactgccataatcaggcatgccatgatggcacccatatctactcgtccataacttcccttcatgtactggatgatgatggagatggttttgtatttcttaatatcaagaatcaggtatggaagaaggaagtcgttccagatccacattgcttcaagaatacctacagaaatataagttggtttcataattggaaggacaacagagaagaaagtacggataggattacatccgtcaatcatagctgcttcctcgatttcaacagggatagactttacaaagccgcagaacataaatacggcaagtccggcaccaaaccccagataaacaataatgagtccccatggagtatttaatccaagtgtatcagcagttcctgataaagtgaacataaccatctggaaaggaattaccatggaaaatacgcataaaaggtaaattaattttgtaatcttgttttgtacgcgggtaatgtaccatgcacacatggaacagcatacgaggataacgataacagagagaacggtaataaatacggtccagcctactgctttgataaagtcgtattttgagatactggttaaatagttctcaagacctacataacttttttcatttggaagtttaaatggctctaaactgatgaatgctttctttttaaaggagttcatcaaaacgattaaaattggtgagacaaataatatggaaataagggtaaaaaatatagttgcaaaaataccacttgttttatttttcattattgctgtacctccttgctcttagtagcataaagctgaatcataccgatagcgacaacgatgataaagaagataaccgcttttgcctgaccgacaccttcatatccgacacggccgtagaaggtatcgtaaatattcagtgccatcatttctgtctgatgcatcggttcaccgcctgtcagggacaggttctggtcaaagagtttaaatgagtttgtaattgttaaaaatgtacagattgtaatagaaggcatcatgtttggaatcgtaacatgaatgagacgctgccatttatttgctccgtcaatcatggcagcctcatttaaggagcctgggattgcctgaagtccggcgatgtaaacaatcatcatgtaaccaatctgctgccagcatattaaaatgacaagaccccagaaaccaagctttgcacttaatttcagtgccaggtcaaatttttcaaaaataccatcaaagattaactgccagatataaccgagtacgataccaccgattaagttaggcataaagaatatagtacggaaaatgtttgtgcctttgattttctgtgtcagtgcaagtgcgatagcaaaggcaagaacgttgattaaaactaaagttacaacagcaaaaactgctgtaaagccaaatgcatgagtaaatgtattgtctttaaatgcttctacataattagataagcccacgaaagaggcatctctgattgtagtaaatttgcaaaatgataagtaaataccttcgatgaaaggaacgatgaagccgatgataaatgctgcgaatgtaggaagtacaaaaatcggccagtattttttaatggacttttccatagtagcaatagcctccttaaaaaatacagggaggacggtatgtccaccctgtatctgagatatgtttataagtttttgttttaatttgtttcgaactgtttcaaatagaggagtttaaacttgttataaaaagttattttgtagcggcagcggcttctttagcccatccgtcaacaaatgcattctgtactaacttccagtttgcgtctgtctgatctgctgcataagtagtaagtgcagaacctaagtcgttcttccactgttcagatggcattgtggagaatgtccagtctacaggagtataacctttttccatgtagtcgtttgcgatgttaaccagtgggttttcagattttaagttgtttttgaaaggaataacgaatcccattccgtctgcgctgcacatcatctttgtaccttcttcagaagttacgcaccagtttatgaaatcaagtgttgcctgaatatcttctttgcttgcatttttatttacacaccagtaattctctgtaccagtacaaagtccctgtttctcttcgccaggagcaccaatataaataggaagcattccaagattatcatttccgatatcagcgatatcaccatatgcccatgtaccattctgatagaatacagcctgctctgttgtgaattcagctacagcgtcatcaccagtcttcttgcttaactgttttgcatcacatgttccattgttgatgtataaatcccagatgttacggtagttatcaagataagtacctttgattgcttttgtatctgtgattccgtctttctggtattcatagtaaataggaaggtttgcaagatgtgttttaaatctccagtcagaagaaccgtccataccagcggaagtaaatgcggagaatcctaattcatcttttctctttgtgatatcttcagcaactttctttaaatctgcgaaagatttgatatcattctgtgtgtaaccagcttttttaagaagtgctttgttgtagattaaaccgtaagtttctgtacagtaaccaacacctgcgatttcatcgccgttctttaattcaaacttatcacttgtaagttcatttaaaatatcagaacctgttaaatcgtagcagtaatctttccatgaagcaagacctacaggaccgttaacctggaaaagagtaggagcttcggatttacccatctcactctttaaagtagtttcgtactggtttgctgctgctgttactactgtaactggaacaccagtttcgtctgtgtattcttttgcaagttcctgccactgttcatctgcttctggtttgaagttaagatagtaaacagaacctttggatgagtccttatcagaagatgctttcttatcggaacttccgccgccacatccggtgagcatggaacaagccatgattgttgctaagcctgctgcaagtaatcgtttcatttttctcataataatgaatcctcctttttaaatatccttgcgtgtcttgcgacttaagagtatgtaactatgtactggaaccgttttcggaaatgtttccagtcgcttgataagcatattatataacttatatgagtagaattacaagtattttttgtcgaatagaaaaaaattgttaaaagtgattgaaaaacataacaaaaattatacatattgaacaaagaacttgactgcaaaatgaatttttttttaaaagggtatggacaaactaaaaaaagtagtgtatactcagccttaaattacagggaaatcctgtaaattaaaatttttattcccccctgaaccgtctcactccactttctgaacggtcagggcaaagagaaggaggataaccgtcagacttgcggtgcggcagtgtggagacctgtcgtaatgtggcgcggaagtaatcgccggctgcgaggtgatatcgtgcggaggcagtatcactaaagtctaagaatatggcagaggtaacattaaaacatattaagaaagtttacccaaacacagagaagaagagcaaaaagggccagaagaagagcaatcttatggttacagacgaaggcgtattagcagttcaggacttcaatcttgacatcaaggaccgcgaattcatcgtattagtaggtccatccggatgtggtaagtccacaacacttcgtatggtagccggcctcgaagaaatcagtggaggagaactcctcattgatggaaagagaatgaatgatgtagctccaaagggtcgtgatatcgctatggtattccagagctatgcgctgtatccacatatgacagttcgcgagaacatggaattcccattaaaacttcgcaagatgccaaaagacgagatgaataagagagtggacgaagtggcagaaattcttgatattacacagtatcttgaccgtaagccaaaggcattatccggtggacagcgtcagagagttgccattggtcgtgcgattgtaagagaaccgaaagttcttttaatggatgagcctttatcaaacttagatgccaagcttcgtaaccagatgagagcagagcttatcaagctccgtcagagaattgatacaacatttatttatgtaacacatgaccagacagaagccatgacacttggtgaccgtatcgttatcatgaaggatggaatcgtacagcaggtcggaactccacaggaagtatttgaccatccagcgaacatctttgtagcaggctttatcggtatgccacagatgaatatgtttgatgcgaaactcgtagaacagtctgggaaatacagtgtagaattaggtggtgtttccattatactttccgaagaaaaacaggcagcactcgctaaaaataacgtaaaatcacaggaaatcacccttggaatccgtccagagcacatcgctttagctcagccaggcaaagatgccatcacaggcaaagtggacgtatccgagatgatgggaagtgcgattcatttacatgtcaatgcctgtggaagagataccattatcatcgtacagacgatggatttaacaggtggagaagatttatcaatcggaagtgaaatctctttcgcatttggcggaaatgcagtccatgtgttcaataaagaaacaggggagaatttagaattctgatttgctgaggactgtgttttggatggggagaaaaatagaattcacttttttctctaagtctctcctatgaatcccacgaagttgccagcaaacacactataaagacagataaagcatattttgcggccttggagcgagtgttcaacactcgctccgaggccgcaaaatatgctttatctgtctttatagtgtatgtgttcattttttaactccataaattcaatattgacatgtatatacaagtatgataatataaaatcaacatgaagctcagttatttaaaatcaaatttttattataggaggagaaaagtatgttaaatgtaacgttagattcccttggattagaaaccgtacgcggagatgagagttttgtttcgagagtacaggatatgccagttagtaaagaagagtttttcgatttaacaaaaatggcaaagtacgtaggtgtaacagaacagtttaaggatgttatcaacacattccatacaccggaaggggaaactcctgcaggttttaagcgagagcttgtgatggaaaaagacggtgttgtaaaggttgatctggtaagagatatttcttatgataagaatggtatattaagaccaacaaatgtattgttttctgccgacagtgcgaatccatatgaagtggaaccaatcagccctttaatttccaatttgacctgtaacccgggaatcatttacgatttatttattaataatccaaaggctaatgttggaaataaatataagaaccgtgatgaagttatggcagaaatcggaagagtacttggtccgggatgtgatatcagtgtggagctgaacaatccttttgagcaggatttcaataagattcttgaagaggcagaaaaatttagagaaatgttttctagatatcgtgtagttattaaagtccctcatacaggagccgttacaccacagaatgtaacccagcttctcagtgaaaataaaaaacttgacaagagaccggatcaggttggaacagaagatgcacttcgcgggcataatcttgcattgaaactgcatgaacatggattccgtgtaaactttacattaatgtttgagccgtttcagactatgctggcaatgcaggcaagaccatactttatcaatacatttttaagacatcgtcttttacagtctcaaaatattaaaaaatatgttgatatgtatgaagtttcaaaggataataagattttagagacattaaaagactactttatctcctgtgattattatacagaagcagatagggatatggcattggcagatgttcttgcatttggtaaagatcttcttaaatacagacattttgaagataagcagggtcaggatggattagatggtatgcgtcataatctgcgcgtattaaagaactccaatctaaaagacacacgtcttattgtatgttctatggaaggcccttacaactatccggatattgataaactccttacagaaccagaattccaggatatgaatcacaaagtcgtaattacagcagaaccaaattatcttgcaagatttacatctacgaatcaggtaatcagctatcagagaagatttatgaatgctgcaaatggacagagctaaatagaaatcatatttttttaaaataagatgtatatacatgactggatatatagaagagggaaaaagtatggggaaggcagttatttttgatttagatggtacattattaaatactttagatgatcttgaagatagtgtaaatcataccttaaactattttaaatacccgaaacgaacaaaagcagaagtaagaagcttcataggcggtggcgcaaaagccttaataaaaaaatctttgccagaaaatgtaactgcagaaaaatacgaagaagtattatcctattttcaagcttattataaaaagaacgctgataaaaaaacaggtctttatccaggggtaaaaaagctggtaaataagctttctgatgaaaattattctataggagttgtttctgcgaaaggtgatattgtagtaaaagaattggtagaatcatttttaggagacaaagtaaatgagactttgggagaaaaagaaggcataaaaagaaaaccagccccggattctatcttaatcatgatggatacgctaaaatgcaaaccagaagaaactatttacgttggagactctgaagtggatgtggaagcagccgccaatgcgggaattagatgtgcttctgtcacatggggattccgcgataaggaagaccttgagaagattaatccattgtatatagcggataatgtacaggaactctatgaattaataaagggataattctgagttgccgcaggtaaagtagacgcacccaaagagagaagataccctatatttgtgactctatcactgtgggttgaatgtttgcttacaggctcacattcaatcctcgttctaaggccacaaatatagggtatcttctctctttgggtgctgtctttggctgttgaagtaaattcagaattgggagttttaatttcgtaaatcaggtaaaaatttaaatttctttcggcgtctcctttgtcattcagcaaatcagaatcttatggtaattttcatgaaattagaaatttgcttttacccccgtagccttgctaaaattatgtttatgaaaaaaatcacgggaggctgtaatgagggttatgaggaataagaatgattggatgcaaaagaagagcattattattattatattagtggttcttttattagtagcaattttagctgtggcggcagaacttggaatgaagagtggtggcaggccgaataaaataatagaaaaaattacgaatggaaataataatgaagataattctaattcggattccaataatatgaaagagaaagatagcgagaaagaattcgaggatgatacgaacagtgaattgaatacgggatatggctatgagatggatgtactttctgataagaataattcaacggaggaaaagactgtctatgaaaaaggctatgatcttccagtagataagcaggaagataaaacagcaaaaaaagaattacatgagatgatgcaggctgtctggcctatttatgataaaagcgaaaagggtgataccagcaatgtagtattaccgagtaagactataaaaaagatattagataaaatagaaagctgttctgttccggcattttttagcggaagagaagaacatatgcggaatgcagataaatttgatggatttttaaagaatgcacaaaaaggagaaaaggatagtatcatagtatatgaagttcacgaagatggcggtgttggacggaataaatatatatttgatggacaaaatatgtatgttttatatgtcggctccgtctggaacaatgatgaagatgtaatcagtattgacacaacatatacgagaataaaagaatggaactacacaaaagatggctggtttactggagaattctgcgtaccagaaccaccggaaagatctgaaacggtagatggaaggtttaggattctggtttaattcagtaaacagatagacgaagccaggaagcaaacgaatctatatttatgactttagtcgcggcgtgttgaatgctcgctttcgcgctcgcatccaacacttgctccgaggtcataaatatagattcgtttgcttcctggcttctgtgctatggcggttggagtgaattaaacctagaaacggagagaatttgaggaagaagagtataaagtctaagcccatctggtgaatcctcaaatctctccccaacgataaatggtaataatttcctctctagccaaagcacagctctctggaagataaataaagcatatttgtgacctcggagcaaaggttggatgcgagcgcgaaagcgagcattcaacctgcagcgactaaagtcgcaaatatgctttatttatcttccagagggcgtcaactttgcctgcggcaccccctatttatcgtttcttcaactttggagccaacggcatatcccacccatgatggtcagtatgcagcagcttatgagacatacgagaaagaggtttctccagatactcttcataagtctttaacacttccggattctcatgcgagaaacgacgttcgttctgggaatcaaggaagtagaggttcttggagcgaatctcagccatttccttcccttcgtggattggctgtccaccaccgcctacgcagccgccagggcaggccataacttctacaaagtggtagaatacttcaccgcggcgaacggcttcgattaactttcttgcgttgccaagtccacttactacggcaactttaacttctgtgccgttgatgtcgatagcagcttctttccagccgtccattcctcgtacaccgtggaatgcatctgggtcagggttctgtcctgttgcaagataatagcagcttcttaaggcagcttccataacaccaccggttgttccgaagattacggcagcaccagttccttctccgcaaggagagtcgaagcggtcttctggaagtccgtaaacatcaatgttgagggacttcatatagtcaacgaattcgcgtgtatttaatacaacgtcaacgtcaggaccagttcctgtactgtccatagtaggaagtgcacattcggccttctttgcgatacatggcatgatggaaacgctgaaaatgttttcaggatcttcatgaatcttatcagcaaagtagttcttgatgatggctccctgcatctgttgaggagactttgcagtggaaaggcagtctaccatgtcaggatactgggattttaagaaacgaacccagccaggacagcaggaggtaaacattggccactggtagtcttctttatgtttcagtcgttctaagaactcgcttccttcttccataatagtaagatcggcagcgtaagttgtatcaaatacataatcaaatcccatcagacgaagtgcaccggcaagtcgttctggggaagcaaacttacgggaaagcttgaaggcttcagcccatgcggtacgaacggcaggagcaacctgaacaactgtagtttttcttcttgtatttaacataccgttctgagagaataccggacgtttatcgtcacggcctgacagagcagcaactggacaatgagtgatacactgtccgcaaagagcacagtcggcttctttaatatttcttccaagagatacattaacggtggtacgggaaccagttttggcgatatcccatacttttaaagactgtactttatcacaaatttggatacagcgcatacatttgatacatttgctctcgtcacggataagaggaaagtccatgggccacttctcttctgtaatgtgttgtttgaaagtaccacttccgaattcaaggtcgttggcaactttctgaagctgacagtttccgcttcgaacacaggtagggcagaagcagttgtgctgtgagagaatcagcttaatattgattcggcgggcatcacgtacttttggggagtttgtgtaaatctccattccttcttttactgtattgttacaggaagtgacgagcctttcgataccttttatttccacaacgcagacacggcaggcaccgatttcgttgatatcttttaaataacacaaagtagggacaatcatttttgcctctctgcaggcttctaaaatcgtagttccctcttcaacggagataggaacgtcatttatcttaatatttaccattcttcaactcgtcctcctttaaatactccataaccaaaacggtcacagcgcaggcagcggtgtgcttcctgattggcctctttgcaggtcatgccgttctccacgatattgaaatcctttttacgttctgtagtatttctttccatcatagtaacacgtccgcaaggtgtcttgttctcaatacgaggttctggaacaacaacgccgctttcaatcttatgattgaatccgaggtaattgtcgatgttggcagccgctacttttccggctgcgatagcacggataacggtagcaggtccggttacacagtctccgccggaaaatacaccatctttttccgcaatagagctatccttctgtgctaagaagcgtccacgctttgcagggatgcctgcacgttcaaatggttcagaaacgatatcctgtccgattgcaacgataacaatatcacaagggatatgtataggttctcttccggaatttgcaggagaaggacgaccgccagtaatcaggccgataatcttagggtcagcaaccatagcagttacatacccttttttatttgtttcgattgcctgaggggcatggagttcaagaatctctgcaccctctgcgatagcagcctcgatttcgtccatgagggcagtcatatcagcctttctgcgtcggtacataacactaacgtttttagctccaagacggatagcagaacgggtagcgtccatagccacgttaccaccgccgacaacgataacatttttgcctgtaaaatcaggtggatttccatctccgatatcacgcaacatctgaatagcggaaataacacccttagcatcttcgccaggaataccaagcttcttatctgtatgtgcaccgatagaaatataaactgcatcgtagttttcttttaacatcttaaaggaaatctctccatctccatcaccgatgcaggtattcatctttgtctcaacacctgtagcaagaatgttctgaacatcttcagcaagacgctcttttgggagacggtagttaggaataccatagtaaagcattccgccgagttcttttctctgttcaaaaacagtacactgatgtcccatctgctgtaaatagtaagcagcacttaaaccagaaggaccgccaccgatgatagcaactgttttaccagtaggttcgcagcattctggaggtggcacaagaccacagtggtcagcggcgtaacgcttgagcccgcggatatttaccgcatcatccacgaagttacgacggcactttgtctcacaaggatgttcacatacgagtgcacaggaagtaacaaatgggttatctttacggattaacttaacagcatctgcataacgttcatctgcgataagagaaatgtaaccaggaacgtcaacaccggcaggacaaagagcaacacaaggaaccggctgttccagatgacaggaacaatgtccgttcgtgatgtgttcaatgaaatcttcacgaaaaccttctaatcctttaagaaccattcttccggcctcataaccaatggcacagtcggcactgtcataaatggcttttgcagtacgttcaattaaactaagtgtttctaaagtggcttttccatccagtacatcttctaacatatcttcaagaacgcccaggccgatacggcatggaacgcattttccacaagtctgtgcatgaaacagcttcaggaaagaagcagtcatatcaacaggacacagtccgggaggactggcaataattcggcgttccagatcttcgtatagattgtcaacgactaactgggccttgcttttttttctgacctcaagtctactcataatctcctccattcacaggggtattgccccgatagcaaaaaatagtctcaatgacgcgattatatcatatgagaaaaaatttgaaaagaaatgataatttattatcattacaataaaaatgttataataataacaatttgcaaaagaaagcaggaagagagtattaatttataaaaaagacagaaaaaaccacatcaaatgataaaatatcatcgataaatgtggtttttctttgcattttcttcaaaaatgtatagcaaaatattttgaaaaagtattagaaaaaatagtgcttacaaaagaaagccgccagattgtaatctttttttaacaatcggtccagcaaggacaacgagaatgattttcacaaggtcaccagggatatatggaattactccggcaagcaatgcctggtaaaaggtaaggtgtgcctcgatggcaagccatgccgtaccaaaaatgtaagcaacaatagtaccgatggcaagaccgacaatctgcataccgtggttagaaaacttttcaaaagcaaatccacagatgattgtcattggaataaatccgatcaggtatccgccagtaggtcctaaaagctttgcaaaaccagaactaaaaccggagaaaacagggagtcctgcaataccaataagaaggtagatcagataacttattgttccaaacttccagccaagcagacatacagtcaggtaaattgccagatttgttaaagaaatcggaacggggctgatcggaatcgggatggagagtggtcctaaaatacaggtgatggcagccataacagcgatgagtgccatctggaatgttgtaaaagattttttctttgtagtagtaatagcagacatgataatttcctctctaaaatgtattgttaaaaataaaactggctccattataaaagaagtagaacgaattgtcaaccataaataaaaaataagttaacaatgcttttctgattgacagggagctgactttggcctttctttcgccacacaagtaaatttttttcaaaaaactggcattctgcacaaatatattgacattttttgcgcttttttgtaaaaataaaaatgggactaaaagtatcaaaaagaaagggagagaaagtatgaagcaacgatttttaagtatttttcttgcgttagccttaatcattccattctttccgcaggtaactttaccagcgaaagcagcggaaacgacagcaaaaacgcaggatgagaacagtaatgaaaacacggatgcttttggaatcaagatggatacaaccattgataccaaaaaggaaaaagcgaataacccttatggaacagaaggctgggtaaatctttttaccgtaccggaactgtttgtttcacaggggtatgatggctacagaagttttgaaacctataattataataatgacagagatcataaagaaggttccattggaagcataacagacggaactcggataggtaaaaaagaggaagggaacaaaaacggatttaccattatggatacggcacctgtcgatgcagagggtgaagggcagaagcgctatgtggctgttcttggctactggcttggaggaaagcgtctggagctttatattgcagataaagacggaaacagagtaagtaatacttatgctattggaggggaaaaaactcttgattatctggaacaagcagatgcatttgaagatacaggatttgtttctgtagcagcaggcgattttaacggagatggaaaggatacagttataggctatgctccgttgatggaatcggatagtgaacagcctcagttgtgggagttctctatcggaagtaatatgcagttagagaaaacaggaactgtctgcaatatatttgatattttaggtacagggaatatagcaacaaaacattcaaataacggaaaagtattcagaaatacaccagttgttcagatgacaacagcagatacagacaaagatagcgtagatgagcttgttgtcacagcaggaatgaataatacgaaggcggatgtaaataaccgccagtcgagaatgtttatttatgataatatcacagaggaagaaaagtcttactggaataaaacttttgagttagataccaaaggatataataatggtaatcagagactccgctgggcatcttcttctgtaggtaatcttgttatgaccggcagcggtgcggactatccggagattatcacagcaggatgggtagataagaaaacaaataaagatgcagatctgacccatgatatcggtgcatatgtaacatcttgtagtaaaacaactaaaaaaggtaattctgcaataggaacgtatgcgaaaagtgaagtaccagcaataggaagtaatggacagccacaggtcagtggatttacaaaggatggacattacagagatgacgtgcagtccctggtcgttgtagatacctttgctgcagatggtgtgaacgcaaaagcctctgtactgattatggatacgatatatacctatgaagcagggaaaggtcttaatgaggaataccgtacggattattttaatcacagtgataatggaattggtacctctatcattacaaatggattggtacaggatgcagtatccggtaatttttccggcaatgaagaaggcagggaacagattgtatttacaacctgtcagaaacgagcatcaaaaaatcaatatttctataagacctatacatacaaaaagacaggtaaatctttctggcagtgtaactcaacaggatatcgtattagtaagaaggggaatgcgtacacatctttatgtgcaccagatattgactcagacagtacgatcgcaagaattaaagacgtatctttaacatatacagagccggaagtgcttgcacttcttgaatcaactccatatttttctgaggtagacgagggagatatcggcaatagtgaaacagcttatggtaaggagaatggagagggaacttctgtatcaacagcagagggacttaccacgaatatcgtagctggttttgagtggtctgttgatgatatctgtgccggctttgtatgcggtgccggctttgagacgagtgtagaacagggatatacctgggagactgctacgagtacgacaaagaaattttccttaaattactccaatgatacgggagaaaatcaagttattgtttacagaagaccggttacaacatatcggtatgaaattaaaggaacaaaagatacgatggtacttgcgagacagggtactctgctgacaagtatgcttccggtggatgagtataatgaggcagctcaaagctatgaactggaagaaatcgcagatggaacacttgccacaccgggcaatccattctcttaccgttcaagtacagcgggtcttaataatgtggcagaaagcaaaataactacccagtatggaaaggaaggaacggtaacacaggaattttcaacagagacagaacaggaaaagacatttacctatgacctgaatgcttcgtttactgcttatggacttgtatttggagtaaaagcaggaggcggtgccggtacaacttattcggaatcgcagtctacgattaatacagaggcgattacaaagacgggtgcagttacaggtaaacaggtagaaggttatgattttaactggaaatttgcacattggacaacaaaggtaaatggtacagaaataccggttcttggttatgtgcttacgaatgttatcgcacctccgtctccaccggaaaatctggcagtagagagtgtaacatctgattctgcgaagattacatgggatgcaggagaaagaggagctgatgaatatcgtatttatcagatttattctgatggaagtgatattcggatcggaacagtcgatggaacagagagtacatacgaagttacaggattaaaaccagatacatcctatacttacgcgattaaggcttataaagaaggaaagaaaggggatgcgatctccggagaatctgttttcagtgagaagcttattgttacgacacttccggagaagatgggaactgtcaccatcactaatccagaaaatgcaagtgtaaagattggcggaagtgctgtatttaaggcggatttatccagtacagcttctgattacagagcaactaattacaaatggcagcgaagagaaaaaggtggtaaatggcagacgattgacggagcaaaatccagtaagcttacacttaatgatcttacagaagcagataataatacagaatatcgctgtattttccgcgtaagttacacaagtgccagctctcttattgaatattacagtaaggcagcgacgcttacagttggtgaaactgcagttgccccagaacttacgataaccggacatgataatacgggaaatggaacacttgccaaaccgtatgccggcaagtccaattataataagaagacaggtacaacaacgcaagagataaagacaacaaagaatattacgatagaaaaatcaggtacgcagccggagttaacagtgtatacagatggagaccaaacggctccgaagtattacggtgttggaaaagatgagaatgacaatatagtatattatcaggtggctaagaccggcgatacgtacactgcaggtgataagattacagttgctgaaaaatattcctatacgaatctaaacggcgctgcagttacggatgttccggcagaatttaacagtggaaaggattctgtaactgtaacgaaaaatgatgttacttattatcttcaggcgaagattaccggaaaacagagagcaggtatcaatacaggaagcagtggagttacatcaacagacagccgtctggaatctatgacaagaatcacatattactggaagtcaaataatggatattatacatatgattcttctgcaccgaatacgcctggaagtgctgtgactttatcagatgccgataaaaatgtattatatgatgtttaccacaaggcagatacgaaagttgttgttggaagaaatgaaacctatacagtaagtgatacaagtacagtgaatggaaagcaggagactacttatgaaaatgagagtcagtacggatttgctcttgtaacgataagtagtggcgaaacgacaacatatacaatcacttctattcaggaggatgtagaagaaacttacacagtaggagatacagaacttgctggttttgatccggcgaagcttacgcttgtgacaaagcaggttattaatacagtagaaacacctgtatatacgacacaggctggggatagcttaactcttcgtgcaaaagtaacagaaaaggacaacagtaaggcagcggcaggtgcatctgtagaatttaagattgtaaatacacagacgaatggagtagagacaatcagtgcaacgacagatgccaatggtgcagcatccgcaaaatggacagcagctacgagtggtctctacagcattcaggtaaatgttcttgccaaatccggttatacagcatcggcaacgaaggcacagtattataatgcaggtggaacgtacgagacaaacacaacagaataccgtcttgtattatccagtgcaggaaagactttgacaggaaccatgacctatggtggaagtgttagttatgagcttcaggaaagagccattaccgtttcctcagatgcggcaaaggcacagactgttggggagtggaagaagtcagaaaagactaatcttacttatacggtagaaacaacagaaaaagacagaaagaaagtggatgaagttaaacagccattatcagtggcaagctataatttccgcgtttatgatggagatacgattgatccacagaaagaacttgcagcggcagctttacaggtaacaaaagcagcagtaacaattacaccggaaattaaaaatggtgtaaccccgtctagtgcttctgacattactttaaaggtggaaccggaaattttgggagtgaaccttaatgatgttcttaatgtgaactgtggatattttaccgataaaacagcgaccggtaagtttgatgttatactttcctacaagacggacagcaatggtgcggtaacagataaagtaaaagcattccagaataattacacagcagtatttgaaagtgcaagctttactgtaaaaccagatagtgcacaggtgaagttttcctgtggagaaaatggtacgattgttggacgttatgcggataactggtatccgatggcatctggaagtaaccagaccaaaggaacgagacttcgttttgcagtggcaccaaacagtggctatggcgtagctaagtggattatcaacggaacggattacgcagtagatgcaaagaatctaccagagggaatgcgtatttctgaagacggaaagatcttagatgtagcttcatttaatccggcatcacagaccgcatcaacaaatccaggtcatacaaaagacggcgttcttacagtagaagtgagcttcaagagtacttctcatgagattacttacaatgtagatggtaaaggaggaaccttaacagccgttaatgaaaatgataagaagattaattctggaactaagattacacagggaagcaaggtgacatttaccgcagaaccagaagaaggatatatcgtatctggctggaaagtagatggaaagacttacaaatggcaggacaaagacgaggattatcttggaacaacattagttcttgaagatatttccaaggatgaaaatgtaatagtaagctttaagaagagcacagcttcctacaaagtaattaccagtgtagcagatgaagatggaaagaccgatacttctcttgcgaaggtaacagcaataaacgcagagacaaaagaagcggtaacagatcttacttctattaaagaaggaacaacacttacctttacagcatctgtagcagataagacaaatcatatggtaaaactgtggcagacaagtaaggatggtaagacctgggaagatgcagcgttaagcggcggaagtaatacatttaccctttacaatatcagtggaaatctgtatattcgtccggtgattaccatcgcccagaaatacagcttaaagtataaggttgtattagatgacggcaaacctagtgagacaatagtaacagataaaaagattgcagaactcacagcgacaagcaatggtcaggaaattgcaagtggggaaagtcattccgcatatattccgatagaatttgccctcactttaaacaatgattactatgtcactggctggagtaagaacgtgaaggcaagcgaagatttatcaggagcaagccttgacgcacttgacagcaatacagaagtcgttgttactatcaaagaaaaaccggttgtgacaataccatccggtatctcgaatggaactcttacagtaatctacaaagatgccgctaacaaagatatatcggtatcaaatggagatcatgttccaaatggtacacagttgcttgttacattaacaccggaaaaaggctatgtcgttgatgaggatgcgttaggtgcatcagtagaaacagaatataccgatgaagataaatctggaaacacaacagacacgaagtcttacaaggtagagaatgtaatagctaatgtaaccgtaaaaggagcatttaaagcacttggaacacataaagtaacttatgaacctgtaattgcttcaggtgagagtgcaaacggaaccttaaccgcaaaggcagatagaaagcagatggacatttacaagattgacaagcttactactggcgaaaaggtatatgaaggaagtacactgacatttacggcagcaccagatcaggattattctgttcaggaatggcgcgttaacggtaaggtcttgaaagaagatggaatcaaagttacagattccacattaacgattgcaaatgtcgaaaaagactatacagtaaccgtacagtttaagaagtcaggaagtgacacaacaatcgctgccggagcaaacggaaagattgtcagtgcagtagcaggaaaggtagatcagattgccaatattgaaactggatttgtccttgcttccggagcaacggtagatattacagcacagccggatactggatataaggtaggctgctggaaagtaaatggaaaggttgttgatggacagacaggcaatacgtatacttacacagctgatgagaacggcacaggagccgcaatcaccgtacagttcgtacagattgattatgcagtaagctggagcgcagtaaacggtacagtgaaagcagaggatacatcaggtacagaatatgaaggcaataaagccgatatacgtggcggaagtaaggtgacatttagtgcaacaccaaaagaagcttataaagtaagctgctggaaagtaaatggaaaggttgtagacggagaaaatgcaaatacatttacatttactgttccaagtggtgcaaaagagacaccagaagttgcttcttataaagtagaggcagtttgtgagaaagaccagtttacattaacttatgcacagccttctaatggaacgctcacagcaaggggagcggcaggcgaagttgcaagtggcgataaagtaaatggcgatgaaaaatatacatttactgtgaaaccggatgcagactatatcgttgaaagctggaaagtagacggtcaggtaattgacagccacagcacttcctatgaagtgacagtaaagaagaatacagaagtttctgtacggcttgttcctgcgtcttataaagtaacttataaagtaaacaatgagcagggtaaacttcttgttggtaaagatacagaggaaaagaccgatggagaaatttcagcagcatatggaacaagtatcaagtttactgcagtatccaataaattctgtcatatcaaaggctggaagcttgatggaacagaagtcacagatacgacagagggaataagcataagtgcagatggttctgaactgactctttccgaagttaagaaagagcatagtgtagaagcaatatttgatgcagctacaatgtatgaagtttcttacgaagttgatgaaacaagtgaaggtgttgcttctaatgcaggaactcttaatgcgaaagctggcaacacagaccttaagcttaaaaaagatcagacaaccacagtagaaggtggaaaaactcttacatttacggcagttccagtgagtgcagactttatggtagcaggctggtatgtgaatggtaagaaagtagaaaatgaactttccaatacgtgtgtcattgaaaaactcgacaagaaagtacatgtaactgtacagtttacacagtataaaggatacgcacttccagtcagtggtgaaggctatgcactttctgagatgaagagaacaccagatgatacaacaccagacacggaaatccgtgaaaatggaacgctttccttcaaggtagcaccagatacagataataaatatatccgtattgataagctggttattaacggatatgactgcctggctgataagctttcagaaggaaaagaacagccagagaactgtaccttagtagaagtacaaaagaatgaggatggaagttatgtgataaccgtttcaggaatcacaggagaaatccagacagatattactgcccacaaacataccttaaagaaggtggataaggtaaatccaacctgtacaaaagcaggaaataaggaatactggatctgtgaggatgaaaattgcaaggaaatgttcttagaagaagcagctatgaaggcggtacagtggaaagatattttacttccggcaacaggtcacaactatcagaatggtatttgcaagaactgtggagctaaagatccgacatatgtagatattcatccaggaacgccaaaagtaaaagcaaaagcgaaaggtgatcgaaagattaaacttagctggagcaaggcaaaagatgcacagggctacatagtatatcgctataatgcaaagacaaggaaatatgctgtgattgctaatacaaagaagactgcctatacagataagaagcgtacgccgggaacggtatacagatatcttgtaaaagcatatggtgtatctttgaataaaaaagtaatttatggacaggtatctaattgtgcatctgctgttacaaagccgcagactccaaagattacatctgtaaagaaagatggaacgacaaaggcagcaattcagcttaaaacagaacgtaatgttaaaggatatcaactctatgagtacatgtggcagacgaagaagtttaaacttgttggaaagattgagggtaaaaaatattataagtatgacagtaaaaagaagaaatttacccgcgatagaaagtctaaagttgtacaaaatgcaaagaaaaagacaatttctgtaaagattacaacaaacaatgtaaactttaaacgttacagaagatatcgtttcaaagtacgttcttatgtaaagtataatggcaagcaaattttcagtaagctttctaaacaaaagattgtaactcgttaaacaggaaatatgatctgtgtttaaactaaaagagacttcccggaaggttcggatgcctcctccttccgggaagtcctttttgtctttacaaatagataaatatgtggtttgtgagaagcatattctttcttgactgcatggcaaaatcagcctattataagagttagaaaaggcagatatctttttaatttttttataaatatatctgcaggtgttggaggaaaatgtagtatggaaggcaaaagactgacaagttatgcgatggaagaattagaatgtccaaagtgtgggcataagcattcccttaaaaagtataaggttattaatgtaacagagaaggcaaaattaaaagaagaaattatgaagaacaggctgtaccagtttagctgtgaagaatgtgagtatatggcaccgcttacatatgacagtttatatgtggatagccaaagaaatattatgatttacatggcaccggtcatgaatgcagagattaaagcagagattgcggagcttgaacaggaaaagggtatagataaacgtcttgtagataatattaatgatttaaaagaaaagattatgattgccgataatcatttagatgatcgtgtgattgagattatcaaaatcatgtatattgaccagatgaaaaaggaaatggaagacgacacacttttgaatattctttttgattataatagagataactattgttttttagtctttttccagaaaaaaggaatagggaagattccgctgacaagagagttttaccgtcaggtggaggacaagtacaaagatgcaattaaagaacattctatggacagctttatgaaagtagatatggaatgggcaggaaagattctttttaaaaaccacaataaatttaattaaaaacaattgattaaaaagaagtaaaaagttcttgcactctacatactgttatggtataataagaacgctgtttgaaataagataactattgaatataattaattaatgaaacatatattggaagaggtgaataagatgcgcgagggaatccatccaaattactatcaggcaaaggttgtatgtaactgcggtaacgaattcgttacaggttctactaaagaagacatccatgtagaaatttgttctaaatgtcattcattctacacaggacagcagaaagctgctaaggctcgtggacgtattgacaagttcaatcgtaaatatggcatgaatcagaattaataaccgtaaggttttaaattaggcggcggtgcaatgtatcacagagaatgttgtgatgttgtaccgtcgcctaattttggttataccagatgtgagatgacacacatcttgcagcaagaatgcgaggcattcttgaaaggaggtgctctttgaaaaagacaagtattggaggacaggcagtaatggaaggggtcatgatgaagaatcttgaccgttatgcagttgctgttcggaaaccagatcatgaaatagaagtaatgacggacgagtataaaagcctgggaagtcgttatgcggttcttggcttaccaatcatacgtggagttgttaactttggagagtctttatatatcggattaaaaacattatcctattcttcttctttttatgaggaagaggattatgagccgggaaaagtggaacagttttttacaaaaatttttggagataagttagaaagcgttctgatgggaatcacaatggtcatttctgttatattggcgcttggaatttttatggtacttccatttttccttacgaatctgatgaaaggatttctgccatcttacagtatacgtaccctgattgaaggaatcatacgtgtggcattatttcttatatatatatggctcatatctaaaatggaagatataaagcgggtgttcatgtatcatggtgcagaacataagacgattaactgtctggaacacggtgaagatctgacaccggaaaatattaaaaagtattcgaggcttcataagcgttgtggaaccagttttctgcttattgttatgattgtcagcattgtcgtatttatgtttattcgtgtggacagcttagtatggaagtttgtgctgagaatccttctcgttccggttgtggcaggtatttcttatgaatttattcgtctggcaggaagaagcgattcgaagattgtgaatacgttaagtaaaccaggattgtacttgcagtattttacaacaagagagccagatgaggaaatgatggaagttgcaattaaggcagtagaaggcgtttttgactggagagagtatcttcgggcaatgcataacggcgaactggaggattagctatgacaatccgggaagttttaataaatatacgagaacgactgcaaaatgcagggattgaagattttgaatatgaaagctgggcatttcttgactggaaacttcatatcgacagagctgaattttatatgaacccgaatggggaggtaaaggaagaacttttagcagagttagaaagtgttctgaaacaaagagagcagcgagtgcctttgcagtatcttatgggtgaatgcgaatttatgggatatgatttctatgtggatgaacgagtgctgattccgagacaggatacggaatgtctggtggaactggcggtggaagatattcggaatagaaagacacagaaccgatgtgagtctaataatacagcagatcagaaaaatgaacagaaagtcaaagtgctggatttatgcactggaagcggctgtatcggcatttctgtagcaaagctttgcccggataccgaagtgactcttgcagatatttctgagggggcgttatctgtagcaaaaaagaatgcacagaacctggatgcaggtgttaccttaatcaaaggcaatcttttcgaaaatatcgaaggcagattcgattacattttatcgaatccaccgtatatcccatcagaagtaatcgaaggcttgatgccagaagtaaaagaacacgaaccgcgactcgcccttgatggcgaagcagatggtcttagcttttaccgagaaattataaatgaggcgcctgattacctgaatccagatggacgaatttattttgaaatcggggcagaacagggagaagacttaacccatcttatgaacgagagaggattttccgaagtaaaagtgcataaagatcttgcaggacttgaccgaatcgtgacgggcatatatagtaggaagtaattgctataataatctgatttaaaatagatatgcagtttgggtaacagtgaaatatgataaaagatataactatttaagaacacataaaaataaaatctggatagtcatttaaagtttaagaaaatgtaaatctggaacatagatggttatcaaggtataagaaggcacagcaataaacttgaatggttatgaataaaagttatagttataaaagcgcaagaaaacaggaggaataaagatgtttgataaattagaggatcttgtaaaacgtctcgatgaggttatgcaggaacttagtgaaccagatgtagttagcgaccagaatcgattccgcaatctgatgaaagagcaaaatgagctggctcctatcgtagaaaaatataaagaatataaagaagcaaaacagacaatcgaagacagtgtagagatgcttgaggaagaacacgatgaggaaatgcgtgagcttctgaaagaggaattatctgaagcaaagaagaatgtagagcagtatgaagaggaattaaaggttctccttcttccaaaagaccctaacgatgataagaacgttatcgttgagattcgtgccggtgccggtggggatgaggctgcattatttgctgctgagatttatcgtatgtacaaaaactatgccgaatctaaacgttggaaaacagagttcattgatgtgaatgagaacggtatcggaggattcaaagaagtttcctttatgattaatggccagggcgcatattcccgcctgaagtacgagagtggagttcaccgtgtacagcgtatccctgcaacagagtccggcggacgtatccatacttctacaatcacagtagcaatcatgccagaagcagaagaagtagatgtacagcttgatatgaacgattgccgattcgatgtattccgtgcttcaggaaatggtggtcagtgtgtaaatacaaccgactccgctgttcgattaacacatatcccaacaggtatcgttatttcctgtcaggatgagaaatcacagcttaagaacaaagataaggcaattaaagtacttcgtgcccgtctgtatgatttagagcagtctaaagcacatgatgcagaggcagaacttcgtaagagccagattggtactggtgaccgtgcagagaagattcgtacttacaacttcccacagggacgtgtaacagaccacagaatcaagttaaccctccatcgtctcgatgacattttaaatggtgacctcgatgaaattatcgacagcttaacagcagcagatcaggcagcaaaattaagcaaattacaggaaatggagcgttaaaaattatgcaggagtggaagaaaaatatcagacaggttgttccttatgtaccaggtgaacagccaaaaaaagcaaatgtaataaagttaaataccaatgagaatccttatccgccttcaccgaaggtaaaagaacagtgtgcaaaaatctgtgctgaaacagaagaactgcgtctttatccagatccgacagctggaatgttagtagaggcaatcgcaaaatataagggattagacagcagtcaggtctttgtcggagttggctccgatgatgtactcgccatggcttttcttacattttttaatagcgaaaggccgatatttttcccggatatcacttactcattctatgatgtttgggctgatttattcaagattccatatgataaaaagccattagatgagaactttatgattaaaaaagatgactactactggaaaaacggtggagtcgtattcccgaatccaaacgcaccgacaggtgtgttaatgccacttgatgagattgaggacattatctctcataatcaggatgttattgttatcgttgatgaagcctatgtagactttggaggacacagcgcacaggaacttctctccaaatacgagaatctcttagttgtgcagacattttccaagtcccgttccatggcaggaatgcgtatcggttacgcaatgggttctgcagaattaatcaaggctttaaatgatgtgaaatattccttcaactcctacacaatgaaccgcacgtccatccttcttggaactgcatccatcgaggatgatgtgtattttaaagaaactgtagaaaaaattgtaaacacaagagaatggttcaaagcagagatgaaaaaactcggcttcaccttcccggattccaaggcaaacttccttttcgcttcccatccgaaagtacctgcaaaggaaatctttgaagcagccagagaaaaagatatttatgtgcgttactttgataagcctcgcattaataactatctgcgaatcacaatcggaacagatgaggaaatggaaaagttcttaaaattcttaacatcttttctgaaaatccagaaataaacatggtattatgatgaaatatattgtaaaatataagtattacaatataagacaatacagggaggattactatgaaaaagattctgtttgcagcttctgaatgcgtaccttttatgaaaacaggcggactcgcagacgtagtaggagcattaccaaaggaatttgacaaaaatgagtgggatgtacgtgttgtaatgccaaattaccgcggaatcccagaagagtaccggaacaattttgagtatgttactcatttttatatgggagtagggccatacattccaaacgtatatgtgggcattatgaagtacgtttacaatggcattacttattactttgttgataacttagattactttggagcaatggagccatattccgatacaagaactgacgtagaaaaatttactttcttctgtaaagcagttctttctatccttccagttattgatttccgcccagatttgattcactgtcatgactggcagacaggattaattccagtttacttaaagacagaatttgcggcaaacccattcttctggggtattaagacaatgatgacaattcataatcttcgtttccagggtgtatgggatatcaatacaatgaaaggtttaagcggacttccagattatctctttacaccagataagttagagttcaaaaaagatgcgaacatgctcaaaggtggaatcgtttattccgactttgtcacaaccgtaagtaacacttacgcacaggagattcagacagcatactatggcgaaggattagacggattgttaagtgcacgcaaccagagcctttttggcattgtaaatggtgtcgattactccttatatgatccgtcaaatgatgtaaagctctatcggaactattcagaatataaccatcgggagggaaaggctgcgaataaagcagaactccagaaacagcttggccttgaagtgaatccgaacaaatacatgatcggactcatttcccgtctgacagaccagaaaggtctcgatcttgtacgctacgcaatggatcgtctcattgatgataatacacagattgtcgtaatcggaaccggtgatccttcatacgaggaaatgttccgttactatgcatggtgtaactctgataaagtttctgctaacatcctctattccgatgatttagcacataaactgtatgcggcagcagatgctttcttaatgccatccttattcgaaccatgcggattaacacagattatcgctttccattacggaacgattccaattgtccgcgagacaggtggattaaaagataccgttatacctctgaatgaattcgaggataccggagacggattctccttcagcaactacaatggagatgaactcattaatacagtaaactacagtaagtacatttactttgaacagccagaaatttgggatcatatgataacgagagcaatggagaagaatctttcatggggagtttcgaagagacggtatgaagaactgtataatacgctgattggacgatagataaacagacgccgctggtaaaaagaagtagtagtaggattgccagaagaacttgcgagaagacccctaaaaaatttattgattttattccgttgtgctaaacgctccattttgcccaataaaacagaaacttcggaaaaagcagtccgaagtttctatggtcaaaattccgcagcacaaagtcataaaattcaataaattttttagtggttctttttcgtattttttgagcaatccgatagaatatctacggcggctgactgtggatgctggcacaaaatcagaattcactttctcaaattttttcaccgatttgttgtcgtatgagtaaacatccgctataaaaactttgaaaaatcgaatttaaatactattttttttatactgttatggattcactgtgttttctcatgaaatcacagcttttcggggaattcccaaatctctccaacatgaattctgattttacttcagaaaccactgtcagaaacatcgaaatcccatcgtccatatttgtggtctcggagcaagtgttggatgcgagcgcataagcgaacattcaacgcgcagcgactaaaatcacaaatatggacgatgggatttcgatgtttcgtcagttttgccaattcaacaaatcagaattacttagaatactatttgtaccaggaacatatacaagattgttcctcccgcaatactgagcaatgtattctttttccatttatgtagaatgaaaatgaacgccagtgcgataagttccggtatgcaatgatttactccgccgattgaatcttttaaagaataaatgacaagaagcccaattactgcattgggtagaactcgtcccagaaatcttacaaactctggggcactgtctgcggagaaaatgataaatggcagaaagcgtgttgtcatggtgccgagcacgactacagcaatggtgataatctgttgtgtggtagtcattatgcattttcctcgctttcgttcattttattatttagggatttggtagatggtagtaggttttcattggctgctttgtccttcacaccgttctttgttttaggagcttttacgactttagctgaatcatctaatctgtttcggcataagaaaaagcttaagatataaagaaatccgatcggattatgaaggagatacaagcagcgataaagcagtaagtttaattgatggatatttaaattatacaaattatcaggcatatgcttcagaaaaatctaaaaactatatagtacagactttgctggagggagcaaaaaataaagtttgcaatttatttccaaataaacatattcaaatgtatgaagacataaatgaaatgttagatggagatatagatgttacgaaaaagtattataatcaggtgggaagattttatgatatgtatcataatacacttgttaagttgaatcatctggaagcgagtctggtagacgatgagccaggaccgttaaatattccagacagtgctgtagaatataatgggcattactattatttatgttgtaataatgaagcagaagattatgcaactgcagaaaattactgcaaggagcaaggcggttacctggcaacaattacatctgagaaagaaaataaatttttatttaattatgtaaggaaaaaaggatattcgagtgcctattttggccttaataatttaaaagacggaaaagcctatcagtggaataatggtgaattactaatttatacaaaatgggcaaaaaatgaaccggataatactttcagtgattatggatattatgtcagatttaacgagaatgcaaaagacggtacatggaaggtcgatacatttagtggcggcgaaacgaattttaataatgtatttttatgtgagtggggagattattctgttactggaaatgatggattaaaagtaacatcaaagaagcgagatattgttttgacattagatatatcagcgagtatggatggtattcctttagatgaaacgaaaaaagctgcagcaaaatttgttgattctattcttaataaaaattcaaatattggacttgtctcttatagtgatgaagcaacaagtctttctggtatttgcagtaatgatgtttttttgaaaaatactataacaagtctttccagtgctgaaaataccaatatagaagatggattatcgagagcttacagtatgctacaattgggacagagcaaaaagaaacttattgttttaatgagtgatggactacctacacttggaaaggacggagaggaattaataaagtatgcagaaaaaataaaagatcagggagtcttaatctatacacttggatttttccaaaatacagaagaatataaagcagaaggccagtaccttatggagaaaatcgcaagtgaaggatgtcactatgaagtatccagttcagaagatttagtctttttctttgaagatgttgcaggtcagatcggtggacagaaatatatctatgtgaaagttgcctgcccagtagatgtgtcagtaacttataaaggagaaacattaagttcggcagaaaatgatcaaaaccttagaacaagttttggaaccttatcatttagggagaatgaggggaaggaaaataatgaagaagaaagtagcggatatagcaacacatatttaaaagaagccgatagcaaggttaaaattctcagattaaaagaaggaacagactacaatataaaaataaatggaactagcgatggggagatggattatacgataggcttcgtgaacgatgaaggcgagtacaatgatttccgaagatttgaagatattgatattaataaagataccgtaatagatacggtggccaatacttcaaaaaaacattgcttaatatagatgaagatggcgatggaaaatatgatttaaaattacaggcaggtgtaaacggatatggagaggaagtaaaaatagacaggggaatatatattatcttagcatatgcatttatcagtgcattaataattaccatcatcgtaagaagaattactatttaattcattaagagaactacagacgaagccattgcccccaataaggcatatttgtgattttagtcgcggcggtttgaatgttcgctcatgcgctcacatccaaaccttgctccgagaccacaaatatgccttattgggggcaatggcttctgtgccgtggctggagagaatgaattaagagaaggtgggaggatttggggatgagatgccaagtcttctacttactcgagaatgattgggatatggagggtatgatttggcagatagagtaatctatctaatgcttagatgcttagactacttgaaagactgggatatggaagatatgatttgactagatatagatatagatatagagacaaaaaattgatattttaaatttgattttataaatattgcggataacataagataatcatgctagacttggttaaaatctagttctttatctaatttttatggaatgaccataggtatgtacatataactcataaaaacggaacttaaaaaatatagaaatccctctttttcaatgattatcacagcaatattcaataatttcagaacaaaaagcagactgttgttattaatctcaactcattaccattttcatttaaatacaaaatatctattcacaatattctgagagcaagcagaaaacttctacctgctccctcaaatccccacaaccactatcttaattcgatcaaaatccagccaaagacagcccgagaagagaaccgataccctatatttgtggcctcggagctacgagactgtagtaaaatgttagaaaaggccgacattaaaagttattgattttgacgactttgtgttttgtacaactgagtcaaaatcaataacttttaatgtcggccttttcatagaagacgatttctcgcagcgactaaagtcgcaaatatagggtatcggttctcttctcgggcgtctgttcttaatgaattaaatagaaatatagttgaattgctacccgttgtttgatagaatatttatggttatagcataatgagtcagtgtgtgcatttttatatagttgcaaatgcattaacgcacagatacaccacaatagatagaaggagaaagaacaaaaatgattattcgtttaaaggatggttctgaaaaagaatatgcacagccaatgtccgtacttgacattgcaaaggatatcagcgaaggtcttgcaagaaatgcatgtgcaggacaggtaaacggagagacagttgatcttcgtactgtagtttccgaagacagcgacttaaatattcttacatttaatgatgaggaaggtaagcttgcgttccgtcacacagcttctcatgtacttgcacaggctgtaaagcgtctttacccagaagcaaagcttgcaatcggaccagcgattgaagatggattttactatgactttgacatggcaccacttacaagagaagatttagatgccatcgaaaaagagatgaagaaggtaattaaggagaatcctccaattgagagatatgaacttccaagagaggaagctatcgcttacatgaaagaaaaagacgagccttacaaagtagagcttatcgaagatttaccagaagatgctacaatcagcttttataaacagggtgatttcacagatctttgtgcaggacctcatttaatgagtgtaaagccaatcaaagcatttaagcttactgcttcttcaggagcttactggcgaggtaatgagaacaacaagatgctcactcgtatttacggaacagcttacacaaagaaggcagacttagaagaacgtctgaaatatttagaagagatcaagcttcgtgaccataaccgtcttggacgtgaaatggaattatttacaacagttgacgttatcggacagggccttccacttcttcttccaaagggagcaaagattatccagacattacagagatggattgaggatttagaggataacgaatggggttatgtaagaacaaagactccattaatggcaaagagtgatctttacaagatttccggacattgggatcattacaaagaaggaatgttcgtacttggtgacgaggaaaatgataaagaagtattagcgcttcgtccaatgacatgtccattccagtattactgctacaagaacacacagaaatcttaccgtgatcttccttatagaatgagtgagacatctacacttttccgtaacgaagattccggagaaatgcatggattaactcgtgtacgtcagttcactatttcagaaggacatttaattatccgtccagaccagacaaatgatgagttaaaaggatgccttcatttagcacagtactgtcttggagtacttggtgtgcaggatgacgtaacataccgtctttctaaatgggatcctaataataaagaaaaatatttaggggatgatgaatattgggagacaacacaggatgctatccgtaatattttagtagatcagggtgtaccttttgttgaggcagaaggagaagctgcattctacggaccaaagatcgatatccaggcgaagaatgtatatggcaaagaagatacgatgattacaattcagcttgactgtgctatcgcagagaactttgatatgtactacattgaccagaatggagataaacagcgtccatacgttattcacagaacatctatgggatgctacgagagaacacttgcatggctcatcgagaaatatgcaggtaagttccctacatggctttgcccagaacaggtgcgtgtgctgccaatttctgagaagttcgctgactacgcagaagaagtaaacaaagaacttaagagaaatggtattttaagtactgtagataaccgttccgaaaaaatcggctacaagattcgtgaagcacgtcttcagaagcttccatatatgttagtagtaggcgcgcaggaacaggaaacaggtaaggtatctgtaagaagccgtttcgcaggagatgaaggtcagaaagacttaaaagattttatctctgcaatctgtgaagaaattcgtacaaaagaaatccgtcaggaagtagaggagtaaaaatacttgtgctctgatagaatagacgccttatagaagataaataatccctatttgtgactttcgtcgcggcgtgttgaatgttcgctttagcgctcgcatccaacacttgttcccaggttacaaatagggattatttatcttctatgagactgtgctgtgataacttcaggtaatcaagtattcttttgaggagatttgaggttgcggtagaggtatcctctatgaaaagcctcgtagctttgaggttgcaaataagggagtatttggtttctatggagctgtgttgtttatgacttcctttgggtgtgtttggttgagggtatcccttgtgactatggtaacgataaattggaatttattaggaaaatatgagttagaaagtttgtggaattgataaaaaaataacaatttaacaaaccgcatatgtggtgtaaatgataaaaatacaaaaaaagtacaatatctagtgcttgttgataaaataaaaaaatcttcaaaaaatgcttgacgcaactctactgttatgataatataatatgcgttgcacatgagaaactcatttttaaaagaaaaatgagaagaatcttaaaagaaaacgaaaaaacttcttgacagattaaaaatcatgtgataatatataaaagttcgcatcgcaaaaagcgaaaatcttcgaaagaagatgaaaaaagttttttaaaaagttcttgacaagaataaagcgatgtgataaaatataaaagctttcgcaagagaaagctaaaaaccttgataactgaataacaaaacaaccttgaacgttaattcaaatttcattcgggttttcctgagagtgatgtctgcaggaaagtccatggaacggaacgaaagttcaaaacctaaataaacagtaatgacaggaaaagaaccagtggttctggaccttgatctgacatcttgaacattttatttgagagtttgatcctggctcaggatgaacgctggcggcgtgcctaacacatgcaagtcgaacgaagcaccttacttgattcttcggatgaaggtctggtgactgagtggcggacgggtgagtaacgcgtgggtaacctgccctgtacaggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggctccggtgccgccgctaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctcctttctaaggaagacaagtagagagttgttttgttattcagttaccaagtgaaaacttgataacgcccttccgggtggcgatgcgctcaggggacacacccgttcccatcccgaacacgatggttaagacctgagcggccgatggtactatgctggagacggcatgggagagcaggtggctgcccggttccttaaaaaatcttttggttgattttgagggaaccaagcaggtgtggcaatacggaagtggaagatgtaccttgaaaactgcacacagatagtttttcttaaaagaaaagcgacatcagatttctatgataagaaagaattgagactaaatcaattctcccaatagcaagtcgaaagacgaaatatgagttttaactcatacgccgaatgttctctacgctaggaggaacaggaggcagccatttcttaggaaatggacatacaaaggtcaagcgaagaagggcgcagggcggatgccttggcactgagagccgatgaaagacgtgataagctgcgataagcttcggggaggagcaaatatcctttgatccggagatctctgaatggggaaacccggctgtatggactacagtcatccataagtgaatccatagcttatggaagggaacccggggaactgaaacatctaagtacccggaggaagagaaagaaacatcgattccgtaagtagcggcgagcgaacgcggaagagcccaaaccgtgatgcgtgcatcgcggggttcggactgcataagggattcagtaacggcaggagaacggctttggaacagccggccagagagggtgagagccccgtatccgaagccagagctgacccggcaggatccagagtaccacgggacacgggaaaccctgtgggaacgagcggagaccactccgtaaggctaaatactactcagtgaccgatagcgtatagtactgtgaaggaaaggtgaaaagaaccccgggaggggagtgaaagagaacctgaaaccctgtgtctacaagctgtggaagtacttcttaagtacgaccgcgtactttttgtagaacggtccggcgagctgcgggtactggcaaggttaagcacttcaggtgcggagccgcagggaaaccaagtcttaagagggcgttttagtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaacccgtaagggttggtagaggagcattcttaggggagcgaagcattaccggaaggggatgtggaccgctaagaagagagaatgccggaatgagtagcgagagcaaggtgggaatccttgcggccgaatatccaaggtttccagagtaaagctgatctgctctgggtaagtcggggcctaaggagaggcagagatgcgtatccgatggacagcaggtttaagattcctgcaccccttgttatcagaactgcggggacacgggaagggaagcagagccgggaatggaaagcccggtgcaagcgaagtagtcgcagggctggaaaatccgccctgcatgagacgaaggcgtgatgcggagcgaaatgaagtagtgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccggaaggtgaggtatatgggctgacgcctgcccggtgctggaaggttaaggggagagcttagcgcgagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctgagaactcatggcgccagccgtgagggagccggtgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataaagtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagcccccctcaagatgagatatccatactcgaaagagtgagagaccccttagagacgatgaggtagatagggcagagatggaagcacagcgatgtgtggagttgactgttactaatcggtcgaaagcttgaccttagagagttattggaatagaagaagatagtttgtgtgtggttttgaaggtatatgatataaaaaagagccagcaaagtgatttgcactttgctggctctttttgtttagtttaacaggcaaagctgactcaaaaagatacatactccatatctgtgactttagttgctgcaggttgaatgttagcctacctgttcacatccaaaccgccgcaactaaagtcacaaatataggggctatgactctttttgggaacgtcaactttgcctgcagcaaactcctatttaatcaatccacagatttctttggccgtttcactatgattcatcgtatagatatgcacataatgcatcccctgttctgccagatcgttaatctgccttgctgcatattcaattccagcctttcgcatatccgaaggattctccccgtaagttgcgattaaatcagagagtgcctttggaatgctggcaccggacagattgatagtggtgttgatcattttcgcgctggtaattggcatgattcctgcatggataggaacagtgattcctttctggtcagctgcatccataaagcggtaaaaagcatcattatcaaagaaaagctgactgattaaagcgtcagcgccctgctctactttgtgtttgagccagtgaaggtcttcttccatagatggtgcttcataatgcttttccggatagcaggcagcagcaacacggaagccagctttctttaaaattgggatgatttcagaggggtgtttatactgacggtttgcaaaatcttcctcactcatatcaaatggtttatccccacgaagagcaagtacactgtggattccagcatttttgaaattttcgattgtggataaaagtttatcctctgttagggccgcacaggtaagatgtgcgatggaacggatacccagttcattttcaatgtgggaggcgatttcagcagtttttttgctgttacttccaccagcaccataggtgcagcttataaattctggatgtaatccttttaattcatcaagtgtctcatataatcccggaaagtcttcccatttcttaggaggaaaaacttcaaaagataaagaaagcgtttttaaaatatcttgtgggtttgtctgcattgtattcataaaattaattcctttctataataagcttaattacatcttgcagaaagcatttttcaaacacgcttcagccctgctgacgtatctttatatgcttagatagaaggcaagatgccaattcatgttcacattttaaccttacttacttatctttatactttaaaattcttatatgataaagtatagataaaaatggatatctgttctcttctttttcaaaatgtttaaagtatattgcaatctgttgctttttcccgttgatattttacccttttttgttagaattatcaagaaagtgccaactaatcccatgaactgtccaattttttcatagaatgttcaaaatgggtatgatataatgttcacataggagtacatttacgccaatttttggtgagatgtcattattatgagtgtaatgatgaatataaataagaattaaaggagctgacattatggatatcaaagaattattaccaaaggacacagaaggaagattacgtattattcaggagactgtgcctggaagacagattacactggctcatgttattacaagccctaagccaatcgtatatcgtaagttaggactgaacccagatatcgattttgatcgttctgcgatcggtatcatcacagttaccccaagtgaatctgctgtaatcggtgcagatatcgctatcaagagtggagacgtttatctgggattcgtagaccgtttcagcggtactttaattctgacaggacgtatttctgcagtagaatctgctgttaaggctgttatccattatttccagaatgatttaggatatgctacatgccctgttactaagaagtagaataggaatcatggatatatcatagcagctaagaagtggaatagcaatcgtgatataaacagtagtatggctgaatgcgatgaaagcatgaagaagacgtgaatcgggaagacagggtggttatatgcgtaaaataatgtttgttggtcgtagtgaatcaggtaagactacgataatgcaggcgatgaaaggtaaaccaatcacttaccataagacgcagtatgtgaataacttcgatgtaattatcgatacaccaggcgagtacgcagagacgaaacagttatcaggggcgttggcagtttatggatgtgaggcggatatcatcggacttttaatgagtgcgattgaaccgttttccctttatccgccgaatgtagtatctgtaagtaaccgtgaagtcgtaggtgttgttacgaaatgtgaccactgggcagcgaatccggaattagcggcagagtggctacgtcttgcaggatgtaagaagatattttttaccagtgcgtatacaggagaaggtatcgccgaaattttaagttatctcaaggaacctgtcgatgtccttccgtgggaagtggcgaaagcagagtatgataaacttggatttggtccaggcgagagtgagaaacatacacttagaatataaaatgaaaagagatgttgcactagagcgtgtttgaaaaatgattttttaaacacgctctagagtattttttaaatacactttaaatatagtgcagcatctttttgtttaatgtactctcggagtctttctagcacaaaaagactccgagagtacattttataaaaaaggagaatttttatgattgcaaactcaagatgtatcgcctgcattttatcgaaacaggaacgaaaaatacggaaaaattcagacgaacagaagaaaaaagaatacatacataaagttttaaaaatattatatgagtacggcacaaaagaatgtgctccaatggttgaaaagcgcatcaaagacatttataaagaatactatgaggaagatgttgattatgttgcattaaagcatagatataatcaatatatgctcgaaaaagaagaagaaatcagagcacatattcaaaaaaataatgacattgaaacctgtattaaatatgtctgtgccggaaattatattgattttggagtggcaaataaaattgatgatcagttattgcagggacttttggataaagtaaatgaattgaaaatatcaaaaaaagaagtagcataccttgaagacgaacttgcacaggccaaaacgttactttacatcacagacaactgcggagaaatcgtactcgataaaatattcattgaagaactgcaaaataaatataaaaatcttcaaattacagcaatggttcgaggtggaatagcttccaacgatgccacgatggaagatgcagaagaaattggccttaccaatgtcgtaccagtcatcggaaacggagtggcgatcatgggaaccgtcaaagaacagttaagtgaagaagccaaagaaaagatacaaaatgccgatatcataattgcaaaaggcatggggaactttgaatccatgtatcaggagggaatgaatccgtattatttacttttatgcaaatgtgagctgtataaagaaatttttggagttgaaatgttccagccaatattttgtaaggaagaaagactttgatttgccgcaggcaagggagagcgtttactttgctgcgcaaaccagaatccaactattatgctatctgcctatcaaaaatccaatttaatatacaacttgtacattgaaagaaaatgggcgaaaattttataatatttttaacagttagatagaaaatacaaaatagttccaaggatggacatctccttgggactattttgcaataagggacttgtataacagcaggttttatatgtttatataatagaaaggaaggcattgtaataaagtttaaagaaattaatccatcaccacgtacattgatgtttcgataaataacttgcctgctattccagagcatttttttaacacgctctggcgacctgcactgacttcagacaacgatgatcttacatcaccgcaatcagtcggcttgtcgaaaatacattactttctctattagaacatatttcctcttttttgacaagaaagccaaaaaggaaaagattttttgaaaacagggagataaatccataaaatgtacctatcgtgcagcagaattattcatacagggcacagctccagacttgatacattaaatggactggcagctggattaaagatgataaaagcaatgggacagaaataacagaacaagaataataaaacttagaaataacaaaacaagaataccagaacaaaaataatgtaatagctacgataggataaaatagtaggaaaggatgaaaaaaatgagcatatggacttggctaggagccgtttttccgattttatttctgttcctcatgatgagcgtatttcacatgaaaacagaacgtgcggcatttttgggaattatctgtgcaatgatttccgcaattcttatcggaaaatcaactccgcagattgttacgatggatttagaaaaaggagcatttagtgcactcaatattttgattgtaatctggccggcagtattcctttatgaaatgatggaatttgccggtgtatttcagtcaattaaacaaatgcttcagaaaaaaacacaggatgaattggtaatggttctgttaatctgctggctgttttcaagctttttacagggaatcacgggctttggagtacccgttgccgtttgtgcaccgattttaattgcacttggtgttcagccattatggtccgtcataatcacccttttaggacatgcctgggcaaacacttacggaacctttgccttagcgtgggatgccctcatcacacagtcagaaacacagaaaatatttgagacaaaatggcttgccggcttattactccttggagtcaatttcgcaggagccttacttattagctggctttatggaaaaggaaaagctcttcggcacatccttccatttcttctgattattagtctcgtacaaggcggcggacagctcattgtaagctttactaactctgccatcgcagcgttcatcccaaccacactcgcactcgtagtcggatggctcatacttagtgcaggattttatacgaaaccgtggaaaatggattcaaagcttatggtgagacgggaaaatgaagaaatagaaaagcagctcaataaaacaatcacgacagaacaattagtagaagtaaaagaaaatagttttaataaaccaataactaacggacaggcaatatttccattcatcattttagcagcgatttctgtaatcgtcctgttaataaaaccgatacatgaagtaatgaatcagaccatatttgccctgtcattcccacagatagagacagggagaggattcatcgtagaggcaaccgacagctatggcgcaatccatatattcacccatgcgggattcgtccttttacttaccgtaattgttacactctttttatacttgcaaaagggatatctggataagcagaaaataaaatccattattacagcaactttgaaaaaaattattccgacttccctcggaatcttatttctcattgtaatgtcgcaggtattaaaaggaagcggtatcatgcagctcatcgcacagggagtaacacagttaactggcaaatattatagctttgcagtaccattcctcggtttgttaggggcttttgtaacctcatcaaacacttcctcaaatattctgctcggaagcttccagaaaactgctgcagatatgatttccgtaaatgaagccgctatccttgcagcacagaccgccggaggagctatcggtacagtagttgggccttccactatccttctgggaacgacaactgcgggttgtgaagggaaagaaggagaagtcttgcgcttcatgttaccaatagtcctcgtagaagccgcaataacggggatagtgattactgttttaattcattagataaactatagacgaagccattgcccccaataaggcatatttgtgattttagtcgcgtcgtgttgaatgttcgctctattcgctcgcatccaacacttgctccgagaccacaaatatgccttattgggggcaatagcttctatgctgtggctagagaaggtgaattaaacaggggagatttggggacagaagctgatgtcttctgcttactcgagaatgagagcgtctctttgcctgcggcaatccagaatttaaattataacatatgtgctcgaagttcttctgcactcatctgtgataacattgccggagcaatatcaaatacgcttcttgcaccacattctcccttcttagaaagcctgtgagcagcacgggcataagcaacgagaacgcttcctgtaaattctggattagaatcaagttttaaggaatattcaataacatgtttgttaccttcacagcctgtctcaccagtacggataacgaatccgccgtgaggcatcttgctgtgatttgcctttaattcttcttctgtgataaatgttacagttgtatcataatcggagaagtagttcggcattgtcttgattgcattttcaatagctgccttgtcagctccttcttcagctacaacgtagcactctcttaaatgtttctgtcttgtggtaagttctggttcacttccgcttctaacctgttctacagcatcctcaataggaacggtgtactggattgcatttttaacaccatcaatacggcggatagcatcggaatgtccctggcttacacctttaccccagaaagtataagtacttccctgtacaagaatagattcagcataaagacggtttaaagagaacattcccggatcccagcctacagaaataatgctgatgttatttccctcttttgcagccttgtctacatttgcaaaatactcaggaatctttgcgtgtgtgtcaaagctgtcaattgtgttaaaagaagcagcaacttccggtccgattactggaagatctgtagcagaaccaccacagagaatcattacgtccacttcccccttcatagataccatatcatcaaaatgctttacagcagctccttctgtctggatagataccgtagcaggatctcttcttgtaaatacagcagctaattccatatcatcattacgtttaatagcctgctctacaccgcggccaatattaccataacctacaataccaattttgattttgtccattgtattttacctcacttattattttttcggttcaattataacataaagggtggcagaattagaagaaaaaagtgtttttcgcataaattatttcattaggtttataataattttacataaaatataaataaaaggggacagggaaatgaagtatattttaaagcgggaaatgcttgtatgttatgaaaaagttcttatagaagaggaaaaaagtcaggcaacgatagaaaaatatatgcgagatgttcgaaagttttttcaatatgtagaagaaatggggaaaaaggaaggcatcacaaaagaaatcgtactttcttataaaagaagtctgatagaagagtatgcaccttccagtgtaaattctatgttagcgtcactcaatcatttttttaaagtaaatcattggtatgaatgtattgtgaaatcattgaaaatacagcagagaacttttcgggcaaaagaaagagaactgacaaaagaagaatattacagattattgcgggcggcacaaaaagaaggaaaatatcgtttgtattgtattcttcagacaatatgcggaagcggaatccgtgtcagtgaattaaaatatattacggtaaaagcagtaacgcgaggcagggcagttatatttatgaaaaataaaacaagaacgatattattaccgccaaagctttgtcgcttgttgaaagactattgtaaacaagaaaaaataacttcgggaatgatttttataacacgaagaggaaatcctgtggaccgaagtaacattctccatgaaatgaaaaatttgtgcgggacagcaggagtcgaaagagaaaaagtatttccgcataatctaagacatctatttgcttacacatattataaagcagaaaaagatattgcacatctggcagatatattgggacattcaagtatcaacacaacgagaatttatacgatgggaagtggagaggaggaaatgaaacaactatccaatctgggcttgattgtacgatgtggataaaaatataatgaaataaaaatttaatataaataaaaaaaccacataatgcttattatgcggtaaaaactattagacatatctgctctacttgcttacatattatatcataaaattagaaaaaatcaatctttttgtaataaataattgtatacagataaaaaaaggtgcaaaaagacaactgacaaaaattttgaaaatcagtcaggttgtttttcgcgccttttttcttgcgcttattgataaaatttttgttttgctggagcatttttcaaacacgctctaatgaaaagagccgtttttaccgcataataagcattatgtggtaggtaaagaattgcataatgaaggtgctgcgtgagaaggaatatcatatgttattttcaaaaatgcatctttccccgctatttttggaaaggcatttgatagagacagacagaatgcgtccccaaggcatatgtctgttgatagatgtcaggtgtttttcagaaatgaaagcaactttccccgctgtttttgaaaaatatctgacagggcaggcagtacacatccccaaggtgtctgcctgccattttatttttgtagaggaatttcagaaaagtatttataagggaaatataaatctgaatcccgaccattatgccgggcagagtaaggaggttaagtatgaaacatcatcattcatctgggaagtacagattattaaaaagggtcatcatgatgtgcctgtctttgatacttgtctgcagcatgtctatttcggcatttgcggtgaaccgtatcggccgggcagagaatgaaacaacacaatctgtgcagatgacagacaatcaaaagggcgaagctgctgcaaccagacagaaatcgtccgaagcacaaacaaaaacgagacaggaaaacatgaaaaaatcggattctgaatcgaaaacaaaagacaattcagaagaacaaaagaaagattcaaaagacgcagacaacaaaggagccaaagaaaatagcacagaaaaagatgcgaaagaggactccgaaaagaacatttccaaggaagagaaatctaccaaagaggaaaaaaacacagagaaaaagtctgaagagacaacagatgtatccgaggcaacaacaacggcagcgaaagaaacaacaacagaggctgcagagaagaagacagaagccgtaacagaaaagacacccgaagggaaagacagcaaagaagcaacaagcgaggaaaaggctgaggaagagacacaggcagaggatgataaaaataaagagattgcggtaactagtattagtggacctacggaagtgcaggttggaaagacgattaggttaacgggaacatcaggtagctatggatattctcatagttggtctagtagtaataaaaatatagcaaccgtaacaggtaatggttcaacagcagaggttaaaggagtggctgtggggactgttacaatcacacatagatattcttcccaatggaatggtaatacacgaacagaaacgtatcaggtaaaagtaactaaatttgcagataattatagcggagaagcagctatatactatctcgctaacccagctggtgatccatggacaaacgatacaggagcctgggcaccatcacaagacacaagtaatactctggcaaatattagtacaagtggtgcaacctgggaggatggtcatgtagacgatattgtttatgaaaataaaaatattaaatcaaatgtagcaagttatattacttcatggccagacggttccaaaggaagtacctggacagtaaaagaaggagatagttccacagcaagttattttacatttatattaaattctatatgggataagtataaatcttcagtggcagctgatttaggaattggagcagatcaattacagcaatcagacattaaggaaataacattaactccacgtaaaatttcaagagataatggtggaactcacccatatcacatcgactgtgcgctcagtattaaaagcacaaaagtttttactgcaaagttttgggtgaaggagccaggagagagtagtgaatatagacagattgatgcgaaaaattatttaacaggaaatcctgttgctagaacaacaaaagcaacaatcggttctacaaaaacagtaaatggtgttacctatgtccttgatggctggtacccagagaatgccgagggtggagcttacggcagtacaaaaattgcagataatagatggaataattatatcccatcagctgatgaactggcaaatggtacagtaaacttttacgcccactacagtccaactaccacgtccattaaacttaaaaaactggtaacaggaagtatgggagataagcaaaagaaattccactttactatttctatagaaaaggaaaataaaaatgtaacatttaaagttggtaatacttctaaaacaggttccgcaacagtggatttagcaaatgatgaggaaagtactttaacagaaattcctgtcggggcggatgtcagtattacagaagaggattattcaggaagcggatatacaacttcttacgttattgataatggaaacagtgcgctagaaataaaggccaatatatccaatatacaggcgaaaaatgatgtaagtgcacatgagattgtatttacaaataataaagaagccatcccagacacaggaattaccttagattctcttccatttatcgcattacttgctcttagcattgcaggaggaatcttttacctgttttgcagatataaaaagcgctttgtttaaaaggtgacagcgatggcagaaagacataaaagagaggctaaattaaatagagggcgcaaagcaaaaaataaaggaagagaagttttgccaaacacaaaaaagagtacttctacagaggtaataaatcaggaacataaagaaataatcaagtggtttcagacagtaaagttccgcaggacgctatttggaggcgtggatgagaatgatgtctggaagaagctccaggagctgaaccagctttatgaatctgcgattcgggcagagcgggaaagatataacattttgctgacagaccatgaaaaaacatatgaatcccagatttataaatataaacaagaactgatgaaaaatgagggcacgacagagcagactgagatggacaatacagaaaatgaagtgccaccagaaaccagaaatgaggtgcggaggtgatgcggactgcaaaaaatatgagctgttccaaaataatccgcagacgaagaagagaagcagagaccagaaatggttacatacagctactcgcaagaatcatattagtaatcgtatgcggcggattattattcacacagggatttttacttatgagagcgccggacaatggaatgttcccggcaatcaaaggcggtgacctgcttataggattccgtttacagagaaatttcctgaaaaatgatgttgttgtatacaaggcaaatgggaaactgcaggtaggaagaatactgggacaagaaacagatgtcattaccatagatgacaccgggcaacttcttgtcaatggaactccccaaacaggagaaatcgcatttcctacatatgcaaaaaaaggaataaaaaaatatccatatagagtgcctaaaggctgtgtctttctattaggagattacaggacacagacaaaagacagccgcgattacggcccaattaaaatggaggatgtaaaggccaaagtcattacagtactccgcaggcgggaactctaaataaactatctatcttgaataaactaccgaaaggggtttagaaataacaaatttacttattatattaaggaggaaacattatgaaaagagtaaaacgactatttgcatgtttattagcactgacaatgatgcttgggttaagtgcaacggcgtttgcaacagagacagcagaaaaagttcagacacctgcgaatggaggaacagttacatttgaaaaagagtataaattagttggagagggaatttcacctgcagaaacatttgagtttaatattgcaaaagcaggagtagaaaatggtggtgtggatgcagaaaaacaggacatgccaactgtaggaacagctgcttatgctcagaatggagcaacaacagcaggtaataagaaagaggttacagtagcattaccaacttatacaagtgtaggtgtatattcctatataattacagaaaaaacaggtacaacagcaggtgttgcttatgatagcaaatcagttacaatgaaagttactgctgttgacaataatggtactattgagattgcagcagttagctttacaaaagctggaaagaaacttgctgataatgaagctgcattcaacaatacttatacagctaataaacttagtattagtaaaacagtagcaggtaatcttggtgataaatctaaatatttcgatttcacagtaacattaacaggaaaagaaggagaagaatactctcttccggctacaataacaggtggttccgataaaagtggaaaaaaggaaaatgttgcaatcagtggaacaacaacattcaaattaaaacatggtgatacaatcacaattgagaacttgccagcaggtgttagttacaaagtagaagaagcaactccttcagattatacaatgaatgcaacgggtcaggaaggtactatggatgcagaagctaaaacagcagcattcacaaacactaaaactggcgacatcgatacaggcgtttacttagacaaccttccatatatcttagtattcgcaggcgtattagcaatcgcagcagtattcattgtaagaagacgcagattcgaagactaattatcaaaagaatataataatataaacgaagtaatactagagcgtgtttgaaaaataaaagttatacaaaacacaagagttattactgcttgttgatactgaaaatatcaaaaataaatattatttatatcataattgacatattttaaagacatatatgcagtatataataattgattttggcaatataaataactttaaatatttttcaaacacactctagataaagaaacattttaacaaaaatatgctgtagaaaggaggtggctgtatggatgtttcaagaatatttttaaaaacagccaactctcttctcagcgcagtgattgtgctatttcttgttgttgcgggagcctactctgcatatgccctctgggacaatatgcaggtgtatgcttctgtagatgatatacagtcgcagttgttgaaatataaaccgacaccgggcgaggataacggcccgacatttgaggaacttcgggcaattaatccagatgtatgtgcctggattacattagatggaacaaagattgattatccggttcttcagggagaagataatcttacctacatcaataaagatgtatatggcaactttgctctggcaggaagtatatttcttgattctaattgtgaccggtcatttcagaaaaagtattcgctgctatatggtcatcatatggcagaacataaaatgtttggtgatcttgacttatacgaaaagcagaaattttttgataagaaccagacaggaactcttgtcctgcccgaccgttcttataaacttgaaatttttgcatgcattaaaacttctgcgaatgaggataacattttcattcctcaaaaatggcagaaaagcacagatggtctgctgaaatatgcagaaaagagtgcaaagtatattcatcaggatacaatgaaaaaaataggaacttcaaaagacttttcacagattcttgccatgtcaacctgttcgtcagattacacagatgcaagaaccgttattctggcggtaatgaagccttattcgccggagaagtaaggaggagatcaaaacgaaaataagaaaaattccggcagtgttattgcttgtagttttgtgcctggcagtttttccgatttctacttttgcagcagacgctgttcaagtacaaattcctgtcagtatacaaacctcaggtgagacaccttctccggaggaaaactatacggttgagcttcaggcagtggacgatgcaccgatgccgtcagaaaatgtattggagattagtggaagtggtaaagcatttttttcaccaattcaatatacaactcccggcatttactattacaccattacacagcagtctggcacacacaaacgtgggcattacgaccagacagtttattatgtaaaagtttccgtaacaaatggggaaaatggtaatttggagactgtgatagctgcgcatacggatgcagatatgaccgatgcaaaatgcgatattacatttacaaattactataaacctataaagaaaacatcggaaagcacaacagaaacgataccaactacgaagagaaagcctgaaacaaaaccaggcaacaaaacttcaataaagaaaagtaaaaataaagtaaaaacaggtgacaatagcaatgcgaccctgtttgccattttacttctcgtttcaggaacaggattgctgattatcgcaatctcacgttaccgggaaaaataccataagtaaacaaaacaggacagagattattttcaaatatgctctagaaaatagtctctgttttttgttgccttaaaaaagtaaattgcttttattttttcagaaatcactttgaaataaaagaatcatgtcataaagtcaacgcaataacgtgattgtgatgcaatacaaaaaagaaaccggccactggtcggtttcgagagaggaaagtatgaaaaaaatctatcaaaaaaatttgttattgtttttttgatgtctctataatactcagaatttgtgaacagtctgtgaggaaaaaataacgataatctgacgaaaaacgaaaggaaatgttttgttgtaaagattagatgtaatttttcagtatttctattggtgtttcgggagaaagaatctcgttactgtcaggcagatggaggagccagtcgtgaaaggcttttgagcattcgacaaattattttctatgtgttactatgaaaatattgtaaaacaagtattatggataacatgaggggtacaagtcatgagccagaaaattaatacaaatgagttccttaaaaatgtgagaataggactttggcggattgaagttgaagaagggaaattacaatgaatcttctaagtaatgctgtcaaatatacaccagaaggtgggacgatacatttcactatcagggaacttccgtatgaaagagaaggctatgccttattccagaccgtagttgaagatacaggaatcggaatcagcaaagaatatatccctcatctatttgaagcatttagccgtgaaaaaagttcatcagaaagcggtattataggaaccggacttggccttcggattgttaaaaagtttgtagatttgatggagggaagcattgtagtagaaagcgagattggagaaggtaccagatttactgtgacaattccacatagaattgcaacggcaaatgaatatatttctgaagaaaatgcgaaagaattaccagaagaaataaaattaaacaatgtgaggattttactcgcagaagataatatgctgaatgcagagattgcaatgacgcttttagcagatgcaaatgcgtatgtggaactggctcctgatggagaaaaggctctttctatgttaaaaagagcaacagatggatattatgatttgattataatggacattcagatgccgcatatgaatgggtatgaggcaacaaaaaatattcgtggtcttcctgatggacgctgcaggattccaattatagcgatgacggcgaatgcatttgaagaagaccggaaaagagcgatagaatctggcatgaatgggtatgttactaaaccaataaaaatagaggaactgatttctacaattaaaaagatattgaaatcctgatttctgaccgctggcagctcgaaaaatcagtccaagctaatagataaaaaagaaaccgacataaagccggtttcaaaagagaggaaagtatgaaaaaaatctatcaaaaatctgttgttgtttttgatggttttacgatactggaaatttgtgaacaggttgtgaataaagaatgaagataatctgacgaaaaagaaattgctgacgtttttctgtaagaaatgcaatttattaataaaaaacagtatggtaaaaagcaagccggagaatggcttgcttttttcgtatcagctaaattagcacttcttattatcaaaggccggattgaatgcatagaagttcttactgttcaagttatcctgcacaatccgtaaactttcaccaaaacgctggaagtgtacaatttctcttgcacgcaggaatttaatcgcatcataaacatctgggtcatcttttacaaggcgaagaatattgtcgtaagtagtacgtgctttttgttccgcagccatattttccataaggtcagtaattggatcaccggtggactgcattgtatctgcactccatggagtaccacttgccgcaactgggtagataccagttgtatggtcaacataataatccgcaaatccctgttccttaatctgctgtaccgtcaaattgcgggtaagctgatgaacaattgtacaaaccatctcaatatgatttaactcttcagtacctacagaagcatcaaagagggaatacaattagagtttgccctcatatatttggatgagcaacatcttcaggagcattcagctttatgaatatgaataagtatgagcgtctaaaccagcaaaagaaatataggagcgaaaaatccttttcaggtaaaaagcgagttgcggcttattgtcgtgtttcgacagagaaggaggagcaggcgcagtcttttgagagtcagtgcgatttttttcgatgttacattgagcaaaagaaagaatgggagttttataaagtttttgcggatgaagggatttcggggacgagtacaaagaagagggaacagtttaatcggatgattgcggaggcgaagcagaggaagtttgacttgcttattacaaaggggatttcccgttttgcgagaaatacgcttgacagtatttattatacaagagaacttcgcaaggtgggagtcggggttttgtttttaaatgatgggattaatacattagatggagatgcagagttacgtctttcgattatggcatcgattgcccaggaagagagccggaaaacatcggagcgagtgaaatggggtcaaaaacgccgaatggaagagggtgttgtttttggcaggagtatgcttggttatgatgtgagaaatggaaaaatgtatgtaaatgaagaaggagctgaagtagttcggaaaatattttataagtttgttgaggagaggaaaagtacacatactattgcaagggagttactagaggaaggtatttacccgatgcggagcaaaaagtggagaaatacagtgattttgcgtattttgcagaatgaaaaatattgtggggatttggtgcagaagaagacatttacaccggattatctttctcatgagaaaaaatataatcggggtgaggaggagtttgtgattattaaaaatcatcatgagccgattatttcgagagaaatgtttgaaaaagcggaaaagattttttctcgaaataaagcacagaaagattctgagaatacataaaaataaacggaatatttgaagatactggcgaatttgtcaggaaatctgcttcatagtaactttatgaaagagttgaaacagaagaatgtagaagaactttatattcataatagaattactttccagagggcgtttgaaaaatatattgatacttggcgcaacagggagaattgggaaatcaattgttcgctgtgtcgcatttattttgtgttatactgttttatataattttccgttatcaaagtccataagtacgagtggaatgacataacacaagggaaagaataaaaaaatggtaatttgaaaacatttaaaaaagacaaagaaaaggaaagaaaataatgcgatatgtaaaaccacatttttatgatagttttgtctgtacagcaggagattgcccagatacctgctgtgcaggatggcagattatgatagatgaagagtctctggagcgatatgaaaacgagccgggagagtttggaaaaattctgcgcaattcgattgactgggaagaagaatgtttttatcagaataatcgccgctgtgcatttttaaatgatgaaaatttgtgtgatctctacaaggcattgggaccagatgcactctgtgatacctgccgcatgtatccaagacacacagaagaatatgaaggacttagagaattatccctgtctttatcctgtcctaaagcagcaaaaattattctgtcctgcaaagaaccagttcgatttttagaagaggaaactgaggaagaagatgactttgaagaatttgattttatgatgttttctcagttagaagatacccgcgatgttctctttgctgttttgcaggaccgttcgcttccactgacactgcggatatctgtatccgaacaactaacagaaagctatcaaaactgtatagaagaaggacggcagtttgatattgatgaccttctccgagaatgtgaacgccaccagaaagaaggcagcctttcggaatttatctcaaaacatctttctgaaaaaggagcagatgcagcctctctccatcaatggaatcgacagaaaaaagaactgcaggtacttcgaggcttagaacgtcttcgtccagagtggaatcagatactcgatggagccgaaaagtggctctatcaggagaatgaagaaacttataaaaatatttgcaaagaatttcaccaaatgtatggagcattgagtaactacaaagaagaatgggagaacgtaggtgagcagcttatgatgttctttgtctatacttatttctgtggagcagtctatgacgatatggtctgttccaaaatggaaatggcattgttttccattcgctgggtacaggaattcctgattgtacgttggttggaaaatggaaaaacactctccatgaaagacgtggaagaaatttcctggagatatgcgagagaagtggaacactccgacaataatttgaatacactcgaagactggctgtttgagaattactatttaattcattaagagacaaacgaccgagaagagagaagattcaaaccgccgcgactaaagtcacaaatataggggctagactctcttcaggggcgtctcttttgcctgcggtaaattcctatttacaaaagaaactcttgacaaatgaaaaagagtaatatatgatgagtcctagtaagaaaatgggaattgaggagcaagattatgatgatgatgtgtgtcatgccaatgaattgcataacttgtagctgcgaagattcgcagatgtatatgtcttctgagaaggagactggcttgcctgcacataattatcagaatgcgtgttcatagattttagatgaagttttttgaaagggtaagggaatttaagaaataagaaagattctcacctgaataagaattgcatttacacagcactaaagatgagttttaagcaggtagcgatacctgcttttttctttaggtttacaatgcttcaatatgaccttataatagttaacattaagttttaatgtactctaaatctgatagaagtttatattaagttcttttctgcaaaatgcaatatgctaatagctcaagtgtaacagtcagacatagaatagatatacaaaatgttcaggcagagagtacattttcaagaaagggaggaaggcaatgtcagaaattgtaatagagaatctgtataaatcttttgacacaaaagatggaacagtagaagctcttaagaatgtcaatttaagcattgaatctggtgatatttacgggattatcggtatgtccggtgctggtaagagtacactggtacgatgtatcaatttccttgaagtgccgacaaagggacgtgtccttattaatggaaagtcgttaggcgattatacttcaagagagttaagaaagcagagagaagatatcggaatgatcttccagcattttaacttgctcatgcagaaaaatgttttagaaaatgtctgttttccactgtatattcagggtaagtccaagaaggatgcaagaaagagagcgaaagagcttttagatatcgttggactcggtgacagaacgggagcgtttccggctcagttatctggtggacagaaacagagagttgcgattgcgagagcattagcttctgatccgaagattttactttgtgatgaggcaaccagtgcacttgatcctcagactacttcttcgattttggcattgttgaaggacattaatcagcgattcaatatcacaattgtaattattacacatcagatgtctgttgttcgcgagatttgttctcatgtagcaatcgtaaaaggtggtgaagttgcagaacagggaacagtggaagacattttcacacatcccaaaactgctgtggcaagagaacttcttaaaaatgatgtcggtgatgacggagaggaaaaaagaggaacgacagcaggcggcaaagaaattattaagagcggggaaaagattcggattgtcttttctgaaaactctgcatttgagccagttatcgcaaatctgattctcaactttaacgagccggtaaatattttaaaggcagatacaaagaatgtcggcggcgtggcaaagggcgagatggttcttgaatttgctccagactgtacaaagaataaagaaatgaaacagtatcttttagacagaggattagaaatcgaggaggtgagtgagtatgtggactaaagaaatcacagatatgatcatcaacggtgtgtgggcgacactttacatgacagtagcttctacggttttaggatatgtatttggccttccgatgggtgtgcttttggcaatcacggataaagaaggattaacaccgaatgcagttgtatataagatactggatgtaatcgcaaatatcgtgcgaagcattcctttcctaattctccttattttactgattccatttacgagacttcttgttggacagagttatggttccactgcaaccattgttccacttgttatcgcagcgattccatttattggacgaatggtagaatcttctattaaagaagtagacccaggtgttatcgaggcagcccgctctatgggagcaagtaatatgcagattgtcatgaaagtccttttagtagaagcaagaacttctttacttaccggagcaactatcgcaatcggaaccattcttggatattctgcaatggcaggttgtgtcggcggtggcggacttggtgatattgccattcgttacggatattaccgctatcagacaagtattatgatcgtaactgttgtattgcttgtcatactcgtacagattttccagagcattggtatgttccttgcagccaagctcgataagagaaaatagtatatcagttgggagataactcccacctctatagggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaatcctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcccgttatcataaaactacccagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacattattttagcaatattttattatcaaggaacattttggcatatatttgacgccctgtgatactaaacttaccactttttcagtggcgtcctataggtggtgagaaacaagctggtatcagtggtgggagtcaatcccccagctgatatagccttcggcaggattgcagaggtgcgcagtagaagtatgtcatgcattgcatgacgcgcacctcgcagcaagaatgccgaggcattcttgaatatttttcactgcaaaagcttaaaatagacttatagagtttcgtaaaaatggaaaagtaattagatagaattctacaaaactatccgaagttgattgcaaatggtataaattataattatcggctatttagaaaattaagtgaaaacattagtaattcaattgtcaagtgttttacgcttataaattgaaaacttttctaaatagttataataaagaaaaaagagatagtttttgacactatcaaaaaagagaaagcgaggaaacaaaaatgaaaaaatttggagcatttttattagcaggtgtacttgcaatcggagctttaacaggctgcggaagcacagacaagaaagcagaaagttcaacaggaagcacagatacacaggtaatcaaagttgctgcttctgctacaccacacgcagaaatcttagaggaggcaaagccactccttgccaaagaaggatacgacttacaggtaactgtatttgatgattatgtacagccaaacgaagttgtagacagcggagatttcgatgcgaactatttccagcacgttccttatatggaacagttcaacaaagaaaaaggaactaagttagtagatgcaggagacatccactacgaaccatttggaatttacccaggaacaaagaagagtcttgacgaaatcgcagatggtgatgaaatcgctgtaccaaacgatacaacaaacgaagcaagagcattacttcttcttcaggacaacggacttatcaaattaaaagatggtgccggactcactgcaacagtaaatgacattgcagaaaacccacacaacatcaaaatcgttgagttagaagcagcacaggtagctcgtgtaacaggcgaaacagcattcgttgtattaaacggtaactacgcacttcaggcaggatactccgtaaagaaagatgcacttgcatacgaagcatctgattctgaagctgcaaaaacatatgtaaacatcatcgcagtaaaagaagacaacgaagacagtgatgcaatcaaagccttagtaaaagttctcaaatctgatgatatcaagaaattcatcgatgagaaatatgatggtgcagtaattgcgtttgaataaataggaatttgccgcaggcaaaagagacgccctctgtaagataaataaagcatatttgtgactttagtcgctgcaggttgaatgctcgcgtaaaagcgctcgcatccaacctttgctccgaggccacaaatatgctttatttatcttacagagggctgtgttttggctgtggaggaaaattctatttattgctggagggatttgaataggctccagaaggatgtggctttctgtggagttgttttttgaaggactgactcgaattacttctatctctcctgacttcttccccaaatctttctgctaatttgcccgggcagccaagaaacagaagtccgagaatcaaatcacaaatatagatgatttgattctcagacttcgtttgtctactcaccccggcaaattactatttgatgcttctatacctacatcggtgagcactcccattaccggtcggtatggcatggcgaagcgttgggagagataacgcattgccgctccggtctcaccatcagggcccccaaactgactgatgattgcttttgccatagcagcatcggttctttttatattaatcggatattccaatcttttttcataattccacataaatcttatccctccatttcccaaggccacggttcatttgcccatgcccagaagtcagtacctttaggtacagtgtcaagcgtcagaggcgagaagcggctgctatattcttttaatgcctgttttcttgcgtttgtataatattcaaaatattctaaaccctcagcatttttaggatgtgtatcaagaaacatggcacagtctaatgcagcaaagcttacaaaatcaatataacattttaaattctgctgattcatgttacagttacaattttggtttcggttattgttgcaggcagaattaaaattgcagttcatagaacgatgctgacaggagttcatgttacagttttgagaagaatgcatattctgcatcatttctggcacctccttccagtaaaaggcaggtcaagttcctgaaagattgttccggcgcaaagagcattttcaggtttatatatattctgccatttctgccatggaacataggccatagcaagcggcatggaatctaattttaacacttctttttcctgcttatatgaacaggaagaatgattttccatcatggtggtgtctccttaagtttatatagttatatatatgataagcagcctgaaatgtccataagatcagacgatttcaaagaaagaagatagcctatattgtgactttcttcctgggtgtctttcctaatggatttattttatcaaatataatattttatatataatgttgcaatgtcaccagaaaaactcttaaaaatttgacaaggacataaattgacaaatatagatagggggcgtattatataaataactgttttatttcaagatatgttagttccccaaaatgacatattgaaaatccccaaaacagtaagagagtcttccgaagaagtgatcgctttcggaagatttttttatgcagaagaaagtgcacattacttgcattttttaagtcaggactgtataatataagattgattaacttagtttactatttcatcgagaagtgaagtatcaatgaaatagcagatggtagaatttcattttatttttttatgaagaaaggaatggaacaatgacaaaaatagatattatttctggtttccttggagctggaaaaacgactttaattaagaaacttatcgaagaggcactgaaaggacagaaagttgttcttatcgagaatgaatttggcgaaattggtattgacggtggatttttaaaagaatccggtattcagattaatgagatgaattctggatgtatttgctgttctttagttggtgattttaatacagcattgaaagatgttttagagcagtatacaccagaccgcatcatcatcgagccttcaggagttggcaagctttctgatgttatgaaagcggtacagaaggttgtagatgcagaggcgaatgttgtattaaatagccatatcactgttgcagatgcacagagagcaaaaatgtatctcaagaactttggtgagttctaccgtaaccaggttgaatttgccagtgcagtaattttaagccgttcccagaatgtaaaggaagataagttagagaaggcagtagaattacttcgcagcctgaatgataaatgccctatcgtgacaactccttgggaggaacttagcggagcacagattcttgaagtaatggaaggggaaaatgacttcgcaaaagagttaatggaagcagcacaggtttgccctgaatgtggacatcatcatgaacatggcgaagagtgtcatgatcaccatcacgatcatgaggagcacgaacatcaccatcacgatcatgaccacgaagagcatgagcatcatcatgaacatgaccatgaagagcatgagcatcaccatgaaggacacgagcatcatcatgatcatgactgctgtggacatgatcaccatcatcaccatgcagatgaagtatttacaagctggggtaaggaaactcctaagaaatttacagaagaaggaattcgtgcaattcttgataccttatctaaagaggattccgatgagtacggtattatcttaagagcaaaaggtattgttccagatgaaaacggtaaatggattcactttgacctcgtgccaggtgaggacgaggtacgttatggttctgcagaatacacgggaagaatctgtgttatcggttctaaacttaatgaggacaaacttgcagaactttttggtttatagaaaatgtactttcggagtctttcttgcatttgcttttgtaagaagattctgagagtgtatttgaaaccacacaggaggaaaatttatgttaggtaagaaaaaggagctggagattcctgtatatttatttatgggattcttagaagccggaaagacaacctttattcaggaaacactggaagaagattattttaacgacggagaaagaacacttttatttgcctgtgaagagggaatggaagaatacgacgaagaactgttaaagagaacaaatacaactgttgtttatgtagaagagcaggaagatttcaatacagaattcctgacaagcaagcttttacagtattatccagaccgtgttattatagaatataatggtatgtggaccattgatcatttagtagaggcgatggagggaactccacttatgattttccagacaatcgtaagtgccaatgcggaaacatttgatctgtatatgaacaatatgcgttctcttgctgtagaaatgtttaagatggcagaacttgttatcattaaccgttgtacaaaggcaacaccaagagcaacttacagaagaagtatcaaagctgttaaccgtcgtgtacaggtcgtttttgattctatggttccaggtgaggacatggaggaagaagaggatgaacttccatttgatatcagcggagatgaaattcatctcgaagatgatgactacggtgtatggttcatcgatgcgatggaacgtccggaactttatgacggaaagactatggtaatgaaaacaagaatctttaaggcaatgcgtatgccgaagggaactttcgttccaggccgtcatgctatgacctgctgtgcagatgatatccagtttatcggttatctttgtcacacaaatcatgcaaagtcttccacgattaaatccctcaaaaataaaatgtgggtaactcttaccgcagaagtgaaagtggaatataatgaagaatatcaggataaaggtccggtgctttatgcaaaacgaattgaagcggcagaaccaccggaagaggagttggtatatttctaatttgccgcaggcaaaggagacattaagacaccctcagtaaataaaataatccctctttgtgccctgggagcaagtgttaaatgcgagcgcataggaacgagcattcaacactccgcaacgaaagtcacaaagagggattatttttattcccagtgggcgtctctttgcctgcggcagcccagaatcacacatctaattgacggtattatgtaaatgaagtataataaattgaattatgtagaattttcatgaaaaagggggataacatggacaaaatagcagttcttattccttgctataatgagagcaagacaattgaaaaagtaattaaagatttcaaagaagtattaccggatgctacgatttatgtatacgataataactcaacagatggtacagacgagattgccagacgtaacggggcaatcgtgcgatatgaatatcagcagggcaaagggaatgtaattcgccgtatgttccgtgatattgatgcagaatgttatattatgacagatggtgatgacacttatccggctgtgaatgcgccggagatggtggacaaggttttaaatagaaatgttgatatggtcgttggtgacagattatcttctacatattttcaggaaaataaacgtccattccacaatttcggtaattctttagtaagaagttcgattaatcatctgttccacacagatattaaggatattatgacaggctacagagcatttagttatgagtttgtaaagacttttcctgtaatctcaagaggatttgagattgagacagagatgagtatccatgcggcagataaaaatatgtttgtggagaatgtcgttgttgattataaggacagacctgagggaagtgagagtaagttaaatacatattctgatggttttaaagttcttagaacgattgcacgtttattccggacttatcagccgatgaagtattttggttctatcgcaggagtattagcagttttaggcggtggattttccatacctgtgtttaaggattattttgtaacaggtttagtgaaacgttttcctacgcttatcgtatgctgctttgtgattctgacagcgattgtttctttattctccggggcgattctcaagacaattacctggaagaacagacaggactttgagatgacccgtcatcaggcgagaaataaaaaagaagaattattaaaagaggctaaagaagcggaataaaaaataaggtgttcttccggagtcttttacatacttgattttgcaaaaagattgcgggagagcattttaaagaattgggagtaaagtatggatattcttataaagccaaagaaaaaccactatattatttatgcgattataattgcaattttttctacggtggggatgaatatttctttaatgaatacgaatgcggataagcttttaaaaaagtttgaatatagttctacatggaataactttatggctgtattcagaacaagtatatcagggaagaacgatgtaagactgttttatcagttagtagctgtcgggattaccctgatgtttcttgttatattttcttatcgtttttgtgttcgggaaatagtaagttccgccgttatttctattatatttggattttgtatgtggtttggcacagtattttctaacaaagagtcgtggaattattttcttcggaacaaatatgtgaagattttagatatttggtatattttagcgtatgcattagcgatgtttggcgcattgcttatcattggaaaaattgtggctgcatctggaaacaaagcagaacaaaaagcagaagtaaaaacgaaagccaagacaaaagacaaaacggttcgcaatacaaggaaagtattttttatgtgtgctgcagttttacttgtttgctggctgccgtattatatcgtattctggccaggattccagcacacagatcttccgacacagatgttacagtattttcatgtgccgaccagatttcagggacatgatataacggatggagtgaatattttatacagtaatgaccatccatatttccagacaaagttagttggattatgcattgagtttggatttaagattcacaatgtaaatgtaggatattctatctatacatttatacaaatgattgcttttatagtagcatttagcagtattatagcaacattataccgttttgaagtaaatcatacattattaaaaataagtctggttttgtatgcggttattccagtatttccgttatattctcttttgataggcggggattcattcttctcagtatttttcttgtattatatgctggaaattttatggatttttggaacaaagggagctgtcttgaagaataataaattcatactggcaatgattttagaaatttttcttatgtcagcttctaagaaccagggagtgtatgtcgcagcggcaatgttcctgttttgcatcatttactttagtaaataccgggcaagaattgcggtatgcatggttgtaccaattattcttttccagtttggatattgtggagcattttttaaagtggcgaagattgccagtgtaggaaaacaggaagcattatcagtttgtttccaacagacagctcgatatgtaaaatatcatggagatgaggttacacaggaagaagaagaggcaattaaaaaagtcttaaattataaggatattggaaatttatatgatccgaatctttcagacccggtgaaaaagacttttaaaacagaatccacttcagaagatttaaaaaattattttaaagtgtggctttcgatgggattgaagcatccgggagagtatattcagtctttcatagcgaatacctatcagtattattatatggaattccgtaataaaagaggattgtatcttaagccggagattatggatttctacattagaaagcgtccgtgggtgcagaaaagtgaagcaattcagaaactgataagaaagcttcaggtacatgtgccagaaaatttgaaatcagtccgtgaaaagggcgtgcttgcaatggatacagtgcgtcgttttcctgttgtcagctggtttacaaatccaggtgtaataacatggatgatgcttattggattctttgcactttggacaaagaggagatacacatctatacttgaatttttacctgtatttttaatctttggagtctgcctgctatcgccgaagaatggaaatctgcggtacttatatccggcctgctgtatggttccggcacttcttgctgccgcctttggaaatttgcgggaggaacaagcaaatgcaatagaagacacaaaagaagtgtcaaaaagaagaagagcaggaagcagaaaaaagcatagaatagcaagaacactaccagaggataaaaggcagagggtaaaggtgtaaaagaaggggaaagcgtaaaatgaaaaaggcgtgcagaagaataaagtatgaagatacatattgagttaaaaaagaagagatatattctctatgcagcaattattgcgctactaggcgttgtaggtgcgaacatatctatcttacataccaatgcagataagataaccaaacatatagagtacaagtcattcctgacacagcttattgcagtattcagagtcagtattacaaataaagaggggaatgggattttttatcagctaatggcagcaggactatttattctgtttttgattgtattttcttataaatatacagtaagagaagtaatcagtgccgcaatattatcaattctttatggattctgcatgtggataggaaccgtattttctcatagagaatcctgggactattttctgcggaataaatatgtcatgctgttaaatgcattctatatgcttggaaatgcaatcattttatttggaatattgcttttgctatgtcgtgtcattcttcggatatctgagacggataatcagacagagcatagtttagagagagtatttcttacttgtgtactggtactgtttgttttatggctgccctattatatcagtatgtggcctgcgacaatccatggtgattttttgatgcaggtattacagctttttcattatcctacaatgcttcagcaccagcttacctctgacggagtaaatgtattttacagtaacgatcatccatttttacatacgcagctcgcagggctttttattaaatttggtataaaaataaataataaggcgctgggatatggaatgtatacatttcttcagatgacagcctatattggcggtattagcgcgatcattacgactttatataagtttggggcaaatcacagaattttgaaagctgctttaggagcttatgcgctattccctgtatttcctctgtatgcaattatggtaggcggagacagtttttttgctctgtttttcctgtggtttatggtgggaatcctctggatttttaaaacacagggagatgttctaaagaatataaagtttgacatcttttttgcggtaattgtttttctcatgtcggcatcaaagaatcagggaatctatattgccttagttactttagttttctgtgtgatctgtctgaaaaaatacagaataaaaatattagtgacaatgtttgttccgatatttattttccagtttgcctatacaggactgctttttaaagcggcccgtgtttctacagtaggaaagcaggaagccttatctgtttgttttcagcagacagccagatatgtaaagtatcatggggacgaggtgaccggggaagaagaagccgctattaaaaaagttcttgcttataaaaaattagccaaaaaataccagccagctttatccgatccggtaaaaggtacttataaaagtgaagttacatcaacggatttaaagaactattttaaagtctggcttcagatgggactaaaacatccagatgaatacttccaggcattcttcgctaacacttacggctattatgctccactgtttaatagccgtggcggattgtatctgggtcttagtaccgtccgtttttaccgttccaatagaaaatgggcacaggaaatgattccagaatctttttgtgacaaagtagattttaaagaacctaaaatcttgtcaccaatacgggagaggatgaagttcttaatgggaatatcctacaaaattccaatcattaactggttatataacccgggagttattacatggcttatccttatcgcattctttgccttatggataaaaagaaaatactttgacatggcagcattcctgccagtattcttaatcgtatgcgtgtgcctgttatcaccgcgaaatgataatctccgctacatctatccggcatgtgtgttaataccggggatgctggctaatttgcaggggatagataaacagacgaacccgcaccagttgtaatatgcaaaaatgcttcgtttcactgcctccaaactactcgaccgtagtttggacttgcttaaaggcgcatttttacatattacaactggtgcgggttcgtctgttttagactccccagaattacctcttgtttttaaaagccggatctgttggatcgtaattctggttgccaggaatttttccagtagtatcgtttaaagtaatctttccgaatggtcccttattagaagaacggtaaatgcggatagggatactatagcggtttgtttttgcaatgtcatagataagccttgcattacctgcctgtacgcggatacatgcagtggtctggtttgttccaagtccgttataagtacttgcgataagtttcttgttgcttgtgccgcggtacatctcggaatgaatccagctgcgtgttccctttacgaatactccccactggtagtaatgccaagggttgctttttttgtaaatgaaccaggagcgggcagttcctttggaaagatagtggtttccaacataagtactgcggccgtctcttgcggtagaacatacaacagttttggctggaatgtcatatttgtttgtttttccatcgtagagaaggaaagtgatattgtgagttaccagatttaattcgagtttcattcttttctttttgtagctggaaccaaatgttttgaaaagatctttggaaagccggccatttttcttaaaataatatttgtattttgttctgctgccgctgtagtcgcggagatatttccagccagtaacagcctttccttttttcaagtagtagcggttacccttccagtttttccatccagtatatttggtgaaaacaccacgtttataatacttattatctgagataccggtaaataaaacgccgttcttacggagctttccatcatttgtggttgtagtctgtgttgttgctgcctgcacatttattcccttttgtgaggaaaaacctacgccaaaagtcataataaatatgagggaaaagatagtaagttgtcttataaattttttcatgattcctcctgtatttttatttaataaacttgcacactaaatcttaatcgcttataagtcaaatgtcaagaaaagaaagaagtaagcaaaatattaccaatagaaagttggaatatcataaattgttgtaaatattacataataatatcaagaaagtcgtaatggttgtgtttgaccctctttttggccagtgatataatttatacataatattgtgtgattttacaagtgcacgatagctgaattataaaaagaccgcctgaggaatatatccggtaatccagagatgatttgggtggaagaaaggatgggagatatgaagtatgtagcgggtgtagatataggtaacgctaccacagaagtcgctcttgcaaagattgacgggcaggacattgagtttttgaccagtggtattggacctacaaccggaatcaaaggaactttgcagaatatcagcggggttttcatgtctttaaagaatgctcttgagaaggcaggcatggattacagtgatttggcagagattcgtattaatgaggctgcgccagttatcggtgatgtagcgatggagacgatttctgagactgttattacagagtcaacagtaattggtcataatccaagtacaccgggaggaacaggaatcggagttggaacttctgtccttgtaacagagctttctaagattcgtgaggcaaaggatgttatcgtaattgttccaaataaagttagatttgcgcaggcagcagctcttatgaatcaggcaaaggagaatatacatattacaggtgcgatcgtgcaggcagatgatggtgttttactgaacaatcgtcttgataaaaagattccaattattgatgaagttgccatgattgaaaaagttcctttgggaatgacctgtgcgattgaagtagcagagcagggaactgtattatcaactctttctaatccatatggaatcgcaacagtgtttgatttgagttctgaagagacaaagcgcgtggtaccgattgcgcgttctttgattggtgcacgttccggagtagtgattaaaacacctacaggtgatgtacaggaaagaagcatcaaagcgggaacaatcaatatcatcggtcttaaaaaggaagttgatgttgacgttgacgaaggtgcagataagattatggaagccatttcttctattcaggagattgacgatattcagggtgagacaggcacgaatgttggtaacatgttgaataaggttcgccgtgttatggctggtcttacgaataagagtccacaggatattaagattcaggatttacttgcagtagatacttttaatccacagaaggttgttggtggtattgctgatgaatttgcattagagaatgcggttggaatcgctgcaatggttaagtctgaccgccttcagatggagatgatcgcacaggtgcttactgagaagttaagagttcctgtatatgttggcggagtagaagcagacatggctatcaagggcgcattgacaactcctggtacaagcgttccattagctatcgttgatatgggggctggttctactgatgcttctattatcaaccgagaaggtaaggttaagctgattcatctggcaggtgccggaaatatggtttctctcttaattcagtctgaacttggtttagatgactttgaactcgcagaagatgttaaaaagtatacactggctaaggtagagagtttattccatatccgtcatgagaatggaactgtacagttctttgataaaccgttagatccatccatttttgcaaaagttgttcttgtaaaagagaatgatgagcttgtaccgttagacggtgtggaatctttagaaaaggttaaagcagttcgtatggaagcaaagaagaaagtatttgttaccaatgcgattcgttccttatcaaaggtaagtcctacaggaaatccaagagatatccagttcgttgtaatggttggcggttcggctcttgattttgagattccaaactttgtaacagatgcattagctgattatgagatcgttgccggccgtggtaatatccgtggttgtgaaggtcctcgtaatgcagttgctacaggtcttgctatggcttgtgttgagcaggaaaactagaatttggattcgaatgtgtttgaaaaatcattcctgcatttgcgggtcataatttgcagaaagcattcttgaaaaagtaatctacataataatctcacaggataagtgaaagcaagtcttgtgggattatttacattttgtcagaaaatgatttttacaaggaacatatttgcagcatatttcagtgatatgatgttctagagcgtgtttgaaaaatcattccagcaatctgcacgccccaatttgcggtatattttgccttcattcagttggcgtagcccgctacgccgccctcattcaggcgaaatcttccacaaattgtaacgcacatcttgcagaaagcatttttcaaacacgctctagagcgtgcttgaaaaacgctctagtaacttgatagatacagcaggaaaaggctgcataagttgacaggattctgaagcttgtttataataaatctgttaagaatcaattaaaaataaaactatttattgagaggattggaagattttttatgagtaaaatacagattatcacagactccgcaagtgacatttcaaaagagatggaacagaaatacaatttagatgttatttcttattccattgtgataggagataagacttatacaagccgtgtagattttgataatgagggatgttatgagttaatggaggcaagcgagagtcttcctatgacatcacagatcacagcattccagtttatggaattatattatgattactatcagaaaggctgtacagatcttatttttattttgattaatggaaaaggttctgcaacatataataactctttaatggcgatggatatgcttatcgaggaacatccagaatgtgaaggaaagattcacatttacagtcatgacggtggaagttatagtgctggttacggacagcctgcagtaatggcagcaaagatggcccaggaaggcaagtccgtagaagaaattaacgcttatctggaagaaagcattgcacgccgccgcatttattttggaatttacaatcttaaatatgctggaaagtccggacgtattccgagtgctgctgcttttatcggtgacaagattggtattaagccaatcatgaaaatctgggatcacgagattactactgctggtaaatgcagaggagagaagaaggtcgtatctaagatttgcgatatggcaattgcagatatggagccaggttccgagtatcagattgaatatggtaatgatgagaagataaaggaagagatggcagcaaagatgacagagaagcttggatatggccctacaggttatttccagattggtgcagaagttgcagcgaatgcaggtccaagaattgtcggtgttgcctttgatgctaagaaataatttttacagggttaaagactttgtgaaagtagaagggacgtaatacgggggtacatttatggagaagagaagaatatccattctgggagattctatcagtacctttgcaggttatacaccagaagaagctgtcttttatgattcgtatgtacagtgggagacaggagtaaaatctgtggaggatacatggtggatgcaggtaataaaggctttagatggagagcttggaacgaatcattcactggctggaagtatggtatctggtaatttatcaacatcggcgatgtcttatgagcgcatagagaagctgggaaccaatggtataccggatattattcttatcagcgcaggttgtaatgactggggattttgtgtccttccagaagaatttgaggaagcgtatcgaacgatgcttcacagaataaaggagcaatatccacatgcggatatctattgtgcgacacttccagaaggaaaacagccgcagggggagacattttttaatattgacagcacgatttctaagagagtgtattctgatattatcagagagaatgcccaaaaagcgcaagtatatattgcggatcttgcaaatgttcaggaagaatatgaaacagtggatggagtgcatccgaataaagcaggaatgcatacgcttgcccggatgtggatcagggaaatgaaaaagttcatttgtaaataagaatgaatggcagggaggatagaattatttttatgaagaagaaaaatatagtttttgtactttgtcttatttttgcactgggatttcttttcatgccacaggaaggcagaaatgcagaggcagcttcaagaacacgacttagcagtacctctcttaaggttgttccaggaaagacagagaaacttaagatttatggaagaagaggccgtaaagtagtatggacgagtagccggcccagagttgtctcggtagagaatggaaagcttacggctttaaagggcggtacatcaacgatcacagcgagggtggggtctcagaaacttcattgtaaagtacgggttgtcggactgaatacgacaaagattactctggcaaagggagataaatttcagttaaaggtgaagaatggataccgaactacatggacaagcaagaataaaaagattgcaaaggtcagtaagaacggtgtgattaaggctaaaaaaagcggagtcacaacaattgtgtgccgcacaaatggaagaaagttaaaatgtaaagtatatgtagcttctttaaagtatagtacgcttcgcctaaaagcagaaagttcctatcatctttctataaaacatgccggcgatgttttagcatggacatcttcaaatccgtcagttgcagaagtagattctaatggaaatattacaacattaccggtttcaggaacttctgtgcttacatgtaagagtggaaaagcggttcttagctgtaaattaactgtagtaagcccggataacattattacaaatatgagcacacttccaacaagcagtaatcaggaccgatttactgtggcagtaaacagttatccaaatgtacgtcattatacggtatacaggcagtcagcatcaataaatgccagcagtttcaaaaactatatgccatatcatggatgcgcggcgtgtgcagcagcaacagtattgactggttttggaaagaatattacaccgaaacgggttacggataagaatggtttagaatataaagcatttgggaaaaaaatctggaagaaaaattataaaaaagaattaaaagatcagatgcccgtatctctttacggtattaataagattttaaataataacggtatccagacagaatatgtaagacgatttagcgatgccgaggcatgtcagcagattatcagccatttaaaaacaggtaatccggttgtcatagaagccaaaaagggtaaatgggcgaacagttatcatacgatggtacttcttggcttaacggatacagggaaagcaatcattgcagattcagcaaataggacaggatttggtagtaagcagagagtgaagtacgaatccgtatctaatctcataaagcacatgtttgcatgttcagtatccggcgcgaagtctgcgaactgttattttggaagttccagcggtggtggctatatcctcgtaaatccgaatccataatgccggggcattcttgaatcattaatatgtatttgttaatatgaagcctcaatgtagttttcattcttttttacactttttctttgcaagatattttgataggaaaaggtgaaaaaatgcggagaaataaagagaaaaaagccacttttttgtacaaaatcatgaaataacagaaataacgcaattttcttacatttctttttgtaatttcgtggaaaattaaaaaatgatgtgttataataactccaaaatttataacaagatgaaatgaagttttctgtaagatttatttcatatttagaagggaagttttcgtaatggaaaagaaaaatattaactggggcgagctgggctttagctatcagcagacagagaaaagatttgtagctaatttcaaagatggtgcatgggatgacggcactcttacagaagatgctacaattactctgaacgagtgtgccggtgtatttcagtatgcacagacatgttttgaaggtttaaaggcatacacaacagagaacggagatatcgtttgtttccgtcctgacttaaacgcagcccgtatggcagattcctgtagaagactggaaatgccagtattccctgaagataagtttgttgaagctgttgtagagacagtaaaagctaacgcaggctatgtagcaccttatggttcaggagctactttatatatccgtccatatatgtttggttccaatcctgttatcggtgtaaaaccagcagatgaatatcagttccgtatcttcgtaacacctgtaggaccatacttcaaaggtggcgcaaaacctatcacaatcagagtttcagactttgaccgtgcagcacctaacggaacaggacatatcaaagcaggacttaactatgctatgagcttacatgctatcgtagatgcacataaccagggttatgatgagaatatgtatcttgaccctgcgacaagaacaaaggttgaagagacaggtggagcaaacttcattttcatcacaaaagatggcaagtttgtaactcctaagtcagacagtatccttccatctattacacgtcgttctttgatgtacattgcagaacattatcttggaatggaagtagaacacagagaagtacgtttcgatgaagtaaaagacttcgcagaatgtggtctttgcggaacagcagccgtaatctccccagttggaaagattgtcgaccacggtaaagaaatctgcttcccaagcggaatggaagagatggggcctgtaactaagaagttatatgatacacttacaggaatccagatgggacatattgaagcaccagagggatggattaaaacaatctgtaaacatggtgaatgctaattgcagggttagataaaacagacgaacccaagaaataacatagtccatatttgtgactttagtcgcggcagtttaaatgctcgctttatgcgctcgcatctaaaccttgcttcgaggccacaaatatggactatgttatttcttgggttctgttttctttaaagcctgcagattagattttgtgaatcttacagatacccacaactactatttaattcaaacaaaatgatgaaaaaattaccagtttatgatataataaacaaaaatattttatgaatgattatgaaagcgggaggactctgtttatgccagataccagatttattacagaatttgaccagtatttatttggtcaggggacacattatgacttatataataaacttggcgcgcatcctatgacagttgatgaggaagagggagtatattttgctgtgtgggcaccgaatgcggcagcagtttccattgttggtgattttaatgaatgggatgagaatgcgacaccgatggaacgtttagaaccacttggaatttatcagatatttcttacagggataaaagtgggagatatttataaatattgtgttactgcacaggatggcaaaaaaacattaaaagcagacccttatggatttcaggcagaactccgtccgaacaatgcttctgttgtggcagacatttctgattttaagtggcatgacagccgatggatgaagaagagagagaaatttgatgataaaaagaatccaatgtttgtatatgaagtacatccgggttcctggaaaaagcatgaacagacagaagaagatgaggatggattctataattacagagagattgcacatgagctggcagcttatgtgaaagatatgggatatactcatgtggaactgatgggtattgcagagcatccatttgatggttcctggggatatcaggtaacaaattattttgctccaacatcccgtcatggttcaccagaagacttccagtatttcatggactatatgcatgaacataatatcggtgttatccttgactgggtgccagcacatttcccaagagatgctttcggattagcagagtttgacggaacctgcctctatgaatacgcagatccaagaaaaggagaacatccagactggggaacaaaggtatttgattacggcaagacagaagtgcagaatttccttatctgtaacgcgcttttctggttagaacattatcatgtagacggacttcgtgtagatgcggttgcttctatgttatatcttgactacggacgtgaagacggacagtgggttccaaacatttacggcggtaacgagaaccttgaggcaattgaattcttcaagcacctgaatacaatcgtaaagaagagaaatccaggaatcgttatgatcgcagaagaatctaccgcatggccaaaagtaacggataaggcagaatacggcggattagacttcagccttaagtggaacatgggctggatgcacgatttcttagagtacatgaagcttgatccttactttagaaaatataaccatacaaagatgaacttcgcaatggtttatgcatactccgaaaactatatgctcgtcctttctcacgatgaagtcgttcatctgaaatgctctatgatagagaaaatgccaggcagctacgaggataaattcaaaaatcttatggcaggttatgcgttcatgacaggacatccaggcaagaagcttctcttcatgggacaggattttggacagcatagagagtggagtgaaaagagagaacttgactggttcctcttagataaagagccgaaccgccatttgcaggcatttgtaaaagaattacttcatctttataaaaataataaatgtctctacgaatatgactgctatccagaaggcttcgaatggatcaatgccgatgacggtgacagaagtatattctctttcgtaagacattccgaaagcggaaagagcaatatgctcttcatcatcaacttcacaccagtagaacgtccagattaccgtgtcggaacaacttgccgaagaaagcacacacttgtactcagcagtgatgataaaaagttcggcggaactggtaagagaagaccaaaagaatataaaccagcgaagaaagagtgtgatggaagaaagtattcctttagatataaattgccggcatatggggtagcggtgtttaagttctaatttgccgcaggcaagggagacgccactgtaaagaaatctgtagccggattgccagaagattgttgagaagagcccctaaaaaatttattgattttgttccgttgtgctaaacgctccattttgcccagtaaagcagaaacttgctctcaaaacctccactggagcttttttcgacctgctaaggcagcagaaacgaatgcgaagtttctatggtcaaaattccgtagcacaaagtcacaaaattcaataaattttttaggggttctttttctcatattctttgtgcaatccggtagaaagtgttttacagcggctgtgtatttcaatcctacaaatcagttgaaaaaaattgaggatggggacagaagaaataggaactctggcttgttgttgtaaaattgctgtgatattataataatagtttgcgtgtcaatccttaatatttcatttcatggaaagctataatcttataaatgatatccaaatcttacaacatgaattctgattttacttctacagcaaaaaacagctcccagagagaagataccttatatttgtggcattagagtgatgattgaatgtgagcatgggaagcgaacattcaccccgcagtgatagagtcacaaatataaggtatcttctctttctggtggcatctcccttgttacgcaacccagaatagaaaggacttttatgaattgtatacatttaaattttgtgagtgataaagagggaagaaagttccttttccccattcttccccaagatggtttgaacgaaaaaacacttaatgtagtaattactgacggtgattcacaaagaatatatcctgtttttcaacagaaagcgggaatttatggtgattacagcgaatacatgaccaggcatgggtgtgcctgttgttctttgacaacagcattagcggcttttgtggaaaagtatgcagatttgaaaccaaatggaacaatttctgaggtggagagaaagcatttccccgaagaagtatatacggagaattatgggaaagtgatggcaaggcagatgccggtttctctttacggaatttctcttattttgcaagaagagggtgtttcttgcgaatatataggagattttgaggataaagctgccgaaaaacagatgatggagcatttatataagggaaagcccgtcattatagaaacaagccgaatgcgtagaaaaggaaaaagaatcgttcacttttttgataaaaaatatgcgggttcctatcatacgatgattctgttaggtgtggatgaagaggggcagatagtctttactgattctgcaacaagagactgggcaggagaacagcaaagattaaaacgggctaagctgccagaacttatttcctatatgtttccacagaaaaatgtgggggatacgcatttatattttagcagaaaaaggaatacaggcggttatattttgattcgctgaatgagaaagtaagaatgagtgagtattcatagttattcattgaataacgaagtaggcacaatggcaaataaagctttggtatatgcgatatatccaaacgaaaaacagaaacgaacaggaacagaataaatcaaaaatcctacttgacaaaattttcaggttttactacaataagaaacatgatgtttgtccgtacaggacggatgttctgtatcacttatatttgtaataatatagaatttacagtataggagcatcatttttatgtgaatttcaatatgaatttcaaaaatgagaaagacgaagacggaaacaagtagcttttattcatgcattccagagagtgatcggctggtgggaggtcatgtgccagatagtaagtgaatacattcctgagttgtacaccgaatgagacagatatttatcatgttaagcgtgagtagattttagaaattgctgaatgtgatggaacaggtaagatttgtttttagtaggctgtgacggagcggcggccgttatccgcagaggcgttgtttgacgctcatttgaggcagagcatttactctgcgaaaaaaggtggtaccacgaagttatatctcgtccttttattaggacgggatttttttattttatttaggaggattttatgacagtatatgacgaactggttgcaagaggattgattgcacaggtaacagatgaagaagaaattaaggaacttgtcaataacggaaaggctgtattctatattggatttgacccaacagcagacagccttcatgtaggacatttcatggcactttgcctgatgaaacgtctgcagatggcaggaaataagccaatcgccttaatcggtggtggtactgccatgatcggtgatccatccggacgtacagatatgcgtcagatgatgacaaaagagacaatcaaccataacgtagagtgcttcaaaaagcagatgagccgttttattgatttctctgatggaaaagctatgctcgttaataacgcagattggctcttagacttaaactatgtagaattacttcgtgaagtaggcccatgcttctcagtaaataacatgcttcgtgcagaatgctacaaacagagaatggaaaaaggtttatcttttttagagtttaactacatgatcatgcagagctatgacttctatgagttataccagaaatacggctgtaatatgcagtttggtggtaatgaccagtggagtaatatgcttggcggtacagaattgatccgtcgtaaattaggaccagatgccgatgcttacgctatgacaattacccttcttttaaattccgaaggaaagaaaatgggtaaaacacagtccggtgctgtatggttagatccgaataagacttctccgtttgacttctatcagtactggagaaatgttgcagatgcagatgttatgaagtgtatccgtatgttgaccttccttccgttagaagaaattgatgcaatggatagctgggaaggtagcaaattaaatgaagcaaaagaaattcttgcatttgaacttacaaaattagttcacggcgaagaagaagcacagaaagcacaggatgccgccagagcattattcagcaacggcggagacacagcaaatatgccagcatgtgcagttacagaagaagacttaagagatggcacagtagatatccttgcacttcttgtaaaatccggtttagcaggaacacgttctgaagcaagacgtaatgtaacacagggtggtgtaacattggatggcgaaaaggtaacggactttaaggctgtttatacacttgatgactttaaaggcgaaggaaaagtcttaaagagaggaaagaagaaattcatcaagattgtagctgaataggatttgccgcaggcaagacagacgctcccgaagaaagaaggcatcctatatttgtgactctatcacttcgggttgaatgttcgcctccacgctcacattcaatcctcgatctaaggccacaaatataggatgccttctttcttcgggagctgttctttggctgggaatggaattactactgctactgtttcctggctacccgggcaaattagtggaaagatttgggaaagaagtcaggagagatagaaataatccgggaaatcaaatcttacaagattgacacaacaattcattaaaaaataaagcatatttgtggcctcgaagcaaggtttggatgcgagcgcataagcgagcattcaaaccgccgcgactaaagtcacaaatatgctttattttggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttctttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagtccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccatttctcttgcattgggcgtctctttgccacacttttagggaaaaccaacatattctgatacaaaggaaggaagaggtttcaatcatgtttgatttaatttcgatatcggaagcgataaaaagaagctacgattcagaaggtctgctcgttgatgtgcgttcagaggaagtatttaaaaaagggcatctcccaatggcagtcaatctcccatttgaagaaattatgaatgaaaagttcgatatagaggcaatagagaaagattttaatatagaaaaagaacagccagtttttttatattgtgatacaggttccacaagtatgctggcggcgaagaagcttgattctgtgggaattcacgcatacagtgtggttggcggcattatgttttataaaggatacttagaaaaggagaagaacgatttgtggacgatggtgcgtacttcttgacatagcaacatttcctaagtacaattataattattgagaaatatgtagattatgaaaaaataggatgaagtacatgtgtatcgtggtattttaagtagtaatttatatagaaaaatgaggttaggcagatgaagtaatattataaatattgctttagatatagaaacgtgtctttgtataaaaacagaagaaagatgcaatgaatggaggtaagatgagcaacaaatatgagtttattgcgccgtgtcactttggacttgaggcagtgtgtaaaagagagatagcagatttgggatatgagattgtgaaggtagaagatggaaaggtaacttttgccggagacatggatgctttggtaagagcaaacattttcttaagaacaacgcagagaatccttttaaaagtggcagagtttaaggcactaacttttgaggaactgttccagaatgtgaaaaaggttccgtgggaagagtatttcccatccgatgcgagattctgggtgacaaaggcaacttctgtaaagagtaagcttttcagcccttctgatattcagtccattgtaaaaaaggcgatggtagagcggatgaaagagcactaccatattaactggtttgaggaggatggtgccgattatccggttcgagttattatttataaggatattgtgacaattggtcttgatacttctggtgagagccttcataagagaggataccgccgcatggtcagcaaagcaccgattgaggagacattggcggctgcacttatcaagctcactccgtggaataagagccgtatccttgttgatccgttttgtggaagtggaacatttcctattgaagcggcaatgatgggagcgaatatcgcaccgggaatgcaccgcgaattccaagcgcagaattgggacaatatcgtgtctccaaagcttttttccagaggatttgaggaggcagaatctttagtagatacgagcgtggagatggatattcaaggatatgatattgatccgcagattgtaaaagcagcaagagaaaatgcgaaaagagcaggcgtggacggactcattcatttccagcagcgtccggttcatcatttaagccatccaaagaagtacggctttgtaatcacgaaccctccttacggcgagcgtttagaggaaaaagaagatttaccagcactttaccgtgatatgggaaaagctttcgcaggacttgacggctggtctgagtatgtcatcactgcttatgaagatgcagagcgttacatcggaaagaaagcggcgaagaaccgaaagatttataacggaatgatgaagacatatttctacatgtttccaggaccaaaaccaccgagaagaaagaaattggtacagccggaagaataatctgtatgagtattttttcaagtgtactttaatgcgagaatacttagcagaaaatatttaatatgaagatatcgaaaatgttagaagtgatataaaaagcacaagttttttgggaggcagcattttgaaaaagaaactgatatttgccacaggaaataaaggaaaaatgaaggaaatccgggaaattctcggagatttagattacgagattctttccatgaaagaagccggagtagatgttgacatcgtggaagatggaacaacatttgaagaaaatgcaatcatcaaggcaaaaactgtaatggaagcaacaggcagtctcgtattagcagatgattccggtttagaagtagattatctgaataaagagccaggagtatattcagcccgctatatgggagagaatacatcttatcgcattaaaaatcagattattttagacagactgcatggcgtccctgatatcgtaagaagtgctcgtttcgtctgcgtgatcgcagcggcatttccagatggacgagtagagacacgccgggcaacgattgagggaagaatcgcacaggaaccagccggagaaaatggtttcggttacgaccctattttctatcttccagagaaaggaaagacaacggctcagctttcagcagaagaaaagaacgaaatcagtcatcgtggaaaggcattgcgccagataaaggagattttataaatagatgagtgaaaagaaaatgagaattttggtaatcagtgattcgcatggacgtaatgacgatgtggcaggagtaatcgagcaggttggaccaatcgatatgctcatccattgtggagatgtagagcgaggagacgattatatccgttcattggtagattgtccggtacatatggtttccggaaacaacgactataatcttgatcttcctgcacaagacatttttaatattggcgattataaagtgctggttgtccacggacatactttttgtgtgtaccgtggtgtagagagattaaaacagtatgcacttcagaatcatatagatatcgttatgtttgggcatacccataaaccatatatcgaaatcgatgaagatgtaacaatattaaatccgggaagcgtttcttaccc
